(12) United States Patent
Deniger et al.

(10) Patent No.: US 11,939,365 B2
(45) Date of Patent: Mar. 26, 2024

(54) T CELL RECEPTORS RECOGNIZING MUTATED P53

(71) Applicant: The United States of America, as represented by the Secretary, Department of Health and Human Services, Bethesda, MD (US)

(72) Inventors: Drew C. Deniger, Houston, TX (US); Steven A. Rosenberg, Potomac, MD (US); Anna Pasetto, Stockholm (SE); Rami Yoseph, Gaithersburg, MD (US); Winifred M. Lo, Cincinnati, OH (US); Yong-Chen Lu, Rockville, MD (US); Maria R. Parkhurst, Ellicott City, MD (US); Paul F. Robbins, Chevy Chase, MD (US); Parisa Malekzadeh, Norfolk, VA (US)

(73) Assignee: The United States of America, as represented by the Secretary, Department of Health and Human Services, Bethesda, MD (US)

( * ) Notice: Subject to any disclaimer, the term of this patent is extended or adjusted under 35 U.S.C. 154(b) by 682 days.

(21) Appl. No.: 16/651,242

(22) PCT Filed: Sep. 17, 2018

(86) PCT No.: PCT/US2018/051285
§ 371 (c)(1),
(2) Date: Mar. 26, 2020

(87) PCT Pub. No.: WO2019/067243
PCT Pub. Date: Apr. 4, 2019

(65) Prior Publication Data
US 2020/0277352 A1    Sep. 3, 2020

Related U.S. Application Data

(60) Provisional application No. 62/565,383, filed on Sep. 29, 2017.

(51) Int. Cl.
| | |
|---|---|
| *C07K 14/725* | (2006.01) |
| *A61K 35/17* | (2015.01) |
| *C12N 5/0783* | (2010.01) |
| *G01N 33/574* | (2006.01) |

(52) U.S. Cl.
CPC ......... *C07K 14/7051* (2013.01); *A61K 35/17* (2013.01); *C12N 5/0636* (2013.01); *G01N 33/574* (2013.01)

(58) Field of Classification Search
CPC .... C07K 14/7051; A61K 35/17; A61K 38/00; C12N 5/0636; G01N 33/574; G01N 2800/7028; A61P 35/00
See application file for complete search history.

(56) References Cited

U.S. PATENT DOCUMENTS

| | | |
|---|---|---|
| 8,034,334 B2 | 10/2011 | Dudley et al. |
| 8,383,099 B2 | 2/2013 | Dudley et al. |
| 2002/0064521 A1 | 5/2002 | Ellenhorn et al. |
| 2012/0244133 A1 | 9/2012 | Rosenberg et al. |
| 2016/0215019 A1 | 7/2016 | Oren et al. |
| 2017/0145070 A1 | 5/2017 | Hinrichs et al. |
| 2017/0224800 A1 | 8/2017 | Tran et al. |
| 2018/0045727 A1 | 2/2018 | Spetzler et al. |

FOREIGN PATENT DOCUMENTS

| | | |
|---|---|---|
| WO | 2015/123642 A1 | 8/2015 |
| WO | 2015/164594 A1 | 10/2015 |
| WO | 2016/053338 A1 | 4/2016 |
| WO | WO 2016/187508 A2 | 11/2016 |
| WO | WO-2016179006 A1 * | 11/2016 ......... A61K 38/1703 |

OTHER PUBLICATIONS

Bieging et al., "Unravelling mechanisms of p53-mediated tumour suppression," *Nat. Rev. Cancer*, 14(5): 359-370 (2014).
Cancer Genome Atlas Research Network, "Integrated genomic analyses of ovarian carcinoma," *Nature*, 474(7353): 609-615 (2011).
Cohen et al., "Recognition of Fresh Human Tumor by Human Peripheral Blood Lymphocytes Transduced With a Bicistronic Retroviral Vector Encoding a Murine anti-p53 TCR," *J. Immunol.*, 175(9): 5799-5808 (2005).
Cohen et al., "Isolation of neoantigen-specific T cells from tumor and peripheral lymphocytes," *J. Clin. Invest.*, 125(10): 3981-3991 (2015).
Deniger et al., "Mutated Tumor Neoantigens are Recognized by Tumor Infiltrating Lymphocytes from Metastatic Ovarian Cancer," poster presented at the American Society of Gene & Cell Therapy meeting, Washington, DC (May 5, 2016).
Deniger et al., "Mutated Tumor Neoantigens are Recognized by Tumor Infiltrating Lymphocytes from Metastatic Ovarian Cancer," [abstract] *Mol. Ther.*, 24(Supp. 1): S155, Abstract No. 391 (2016).
Deniger et al., "T-cell Responses to TP53 "Hotspot" Mutations and Unique Neoantigens Expressed by Human Ovarian Cancers," *Clin. Cancer Res.*, 24(22): 5562-5573 (2018).
Dudley et al., "Generation of Tumor-Infiltrating Lymphocyte Cultures for Use in Adoptive Transfer Therapy for Melanoma Patients," *J. Immunother.*, 26(4): 332-342 (2003).
Duffy et al., "Mutant p53 as a target for cancer treatment," *Eur. J. Cancer*, 83: 258-265 (2017).
Freed-Pastor et al., "Mutant p53: one name, many proteins," *Genes Dev.*, 26(12): 1268-1286 (2012).

(Continued)

*Primary Examiner* — Julie Ha
*Assistant Examiner* — Erinne R Dabkowski
(74) *Attorney, Agent, or Firm* — Leydig, Voit & Mayer

(57) ABSTRACT

Disclosed is an isolated or purified T cell receptor (TCR) having antigenic specificity for mutated human p53. Related polypeptides and proteins, as well as related nucleic acids, recombinant expression vectors, host cells, populations of cells, and pharmaceutical compositions are also provided. Also disclosed are methods of detecting the presence of cancer in a mammal and methods of treating or preventing cancer in a mammal.

19 Claims, 60 Drawing Sheets
Specification includes a Sequence Listing.

(56) References Cited

OTHER PUBLICATIONS

Goff et al., "Randomized, Prospective Evaluation Comparing Intensity of Lymphodepletion Before Adoptive Transfer of Tumor-Infiltrating Lymphocytes for Patients With Metastatic Melanoma," *J. Clin. Oncol.*, 34(20): 2389-2397 (2016).
Gros et al., "Prospective identification of neoantigen-specific lymphocytes in the peripheral blood of melanoma patients," *Nat. Med.*, 22(4): 433-438 (2016).
Guo et al., "Rapid Cloning, Expression, and Functional Characterization of Paired αβ and γδ T-cell Receptor Chains From Single-Cell Analysis," *Mol. Ther. Methods Clin. Dev.*, 3: 15054 (2016).
Hajirasouliha et al., "A Combinatorial Approach for Analyzing Intra-Tumor Heterogeneity From High-Throughput Sequencing Data," *Bioinformatics*, 30(12): i78-86 (2014).
Holstege et al., "BRCA1-mutated and Basal-Like Breast Cancers Have Similar aCGH Profiles and a High Incidence of Protein Truncating TP53 Mutations," *BMC Cancer*, 10: 654 (2010).
Hwang et al., "Prognostic Significance of Tumor-infiltrating T-cells in Ovarian Cancer: a Meta-analysis," *Gynecol. Oncol.*, 124(2): 192-198 (2012).
International Bureau, International Search Report and Written Opinion in International Application No. PCT/US2018/051285, dated Nov. 28, 2018.
Ivics et al., "Sleeping Beauty transposon mutagenesis in rat spermatogonial stem cells," *Nature Protocols*, 6: 1521-1535 (2011).
Lawrence et al., "Mutational heterogeneity in cancer and the search for new cancer genes," *Nature*, 499(7457): 214-218 (2013).
Lu et al., "Mutated PPP1R3B Is Recognized by T Cells Used to Treat a Melanoma Patient Who Experienced a Durable Complete Tumor Regression," *J. Immunol.*, 190(12): 6034-6042 (2013).
Lu et al., "Cancer Immunotherapy Targeting Neoantigens," *Semin. Immunol.*, 28(1): 22-27 (2016).
Olivier et al., "TP53 Mutations in Human Cancers: Origins, Consequences, and Clinical Use," *Cold Spring Harb. Perspect. Biol.*, 2(1): a001008 (2010).
Parrales et al., "Targeting Oncogenic Mutant p53 for Cancer Therapy," *Front. Oncol.*, 5: 288 (2015).
Riddell et al., "The Use of anti-CD3 and anti-CD28 Monoclonal Antibodies to Clone and Expand Human Antigen-Specific T Cells," *J. Immunol. Methods*, 128(2): 189-201 (1990).
Robbins et al., "Mining Exomic Sequencing Data to Identify Mutated Antigens Recognized by Adoptively Transferred Tumor-reactive T cells," *Nat. Med.*, 19(6): 747-752 (2013).
Rosenberg et al., "Adoptive Cell Transfer as Personalized Immunotherapy for Human Cancer," *Science*, 348(6230): 62-68 (2015).
Singh et al., "Reprogramming CD19-specific T cells with IL-21 signaling can improve adoptive immunotherapy of B-lineage malignancies," *Cancer Res.*, 71(10): 3516-3527 (2011).
Tran et al., "Cancer Immunotherapy Based on Mutation-Specific CD4+ T Cells in a Patient with Epithelial Cancer," *Science*, 344(6184): 641-645 (2014).
Tran et al., "Immunogenicity of Somatic Mutations in Human Gastrointestinal Cancers," *Science*, 350(6266): 1387-1390 (2015).
Tran et al., "'Final common pathway' of human cancer immunotherapy: targeting random somatic mutations," *Nat. Immunol.*, 18(3): 255-262 (2017).
Vogelstein et al., "Cancer Genome Landscapes," *Science*, 339(6127): 1546-1558 (2013).
Weidle et al., "TCR-MHC/peptide Interaction: Prospects for New Anti-Tumoral Agents," *Cancer Genomics Proteomics*, 11(6): 267-277 (2014).
Xu et al., "Heterogeneity of Li-Fraumeni Syndrome links to unequal gain-of-function effects of p53 mutations," *Sci. Rep.* 4: 4223 (2014).
Zhao et al., "Molecularly targeted therapies for p53-mutant cancers," *Cell. Mol. Life Sci.*, 74(22): 4171-4187 (2017).
Houbiers et al., "In Vitro induction of human cytotoxic T lymphocyte responses against peptides of mutant and wild-type p53", *European Journal of Immunology*, vol. 23, pp. 2072-2077 (1993).
Ping et al., "T-cell receptor-engineered T cells for cancer treatment: current status and future directions", *Protein Cell*, vol. 9, No. 3, pp. 254-266 (2018).
Sabapathy et al., "Therapeutic targeting of p53: all mutants are equal, but some mutants are more equal than others", *Nature Reviews Clinical Oncology*, vol. 15, pp. 13-30 (2017).
Wu et al., "Structural basis for oligoclonal T cell recognition of a shared p53 cancer neoantigen", *Nature Communications*, vol. 11, Issue 1, pp. 1-12 (2020).
Wu et al., "Supplementary Information: Structural basis for oligoclonal T cell recognition of a shared p53 cancer neoantigen", *Nature Communications*, vol. 11, Issue 1, pp. 1-17 (2020).
Unpublished data comparing TCR 4196_AV6_with_BV11-2 with other anti-p53 R175H TCRs, National Cancer Institute (5 pages).
Kim et al., "Adoptive Cellular Therapy with Autologous Tumor-Infiltrating Lymphocytes and T-cell Receptor-Engineered T Cells Targeting Common p53 Neoantigents in Human Solid Tumors", *Cancer Immunology Research*, 10(8): 932-946 (2022).
Hoogervorst et al., "Nucleotide excision repair- and p53-deficient mouse models in cancer research", *Mutation Research*, vol. 574, No. 1-2, pp. 3-21 (2005).
Shamalov et al., "The mutational status of p53 can influence its recognition by human T-cells", *Oncoimmunology*, vol. 6, No. 4, p. e1285990, 10 pages (2017).
"cellular tumor antigen p53 isoform a [*Homo sapiens*]", NCBI Reference Sequence: NP_000537.3, pp. 1-8, printed Mar. 25, 2023.
Chen, "Research on p53 gene in ovarian cancer", *Journal of International Obstetrics and Gynecology*, 23(4): 208-210 (1996).

\* cited by examiner

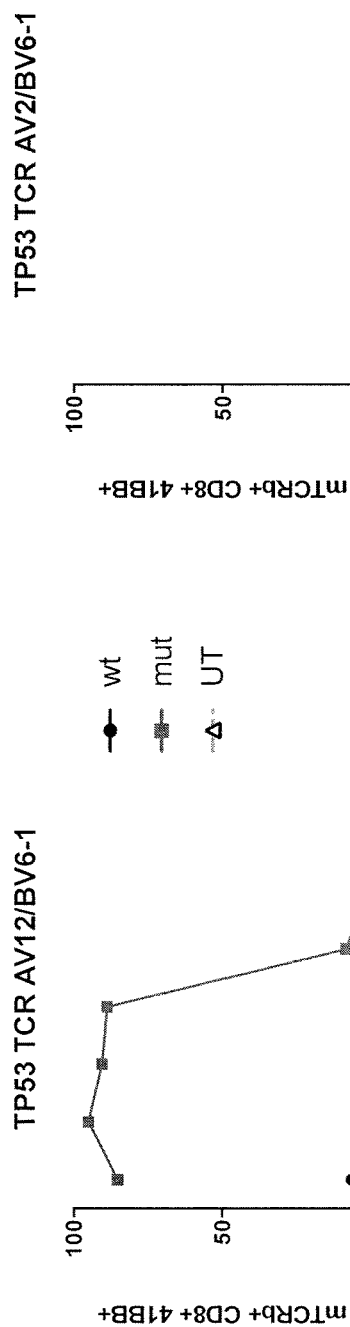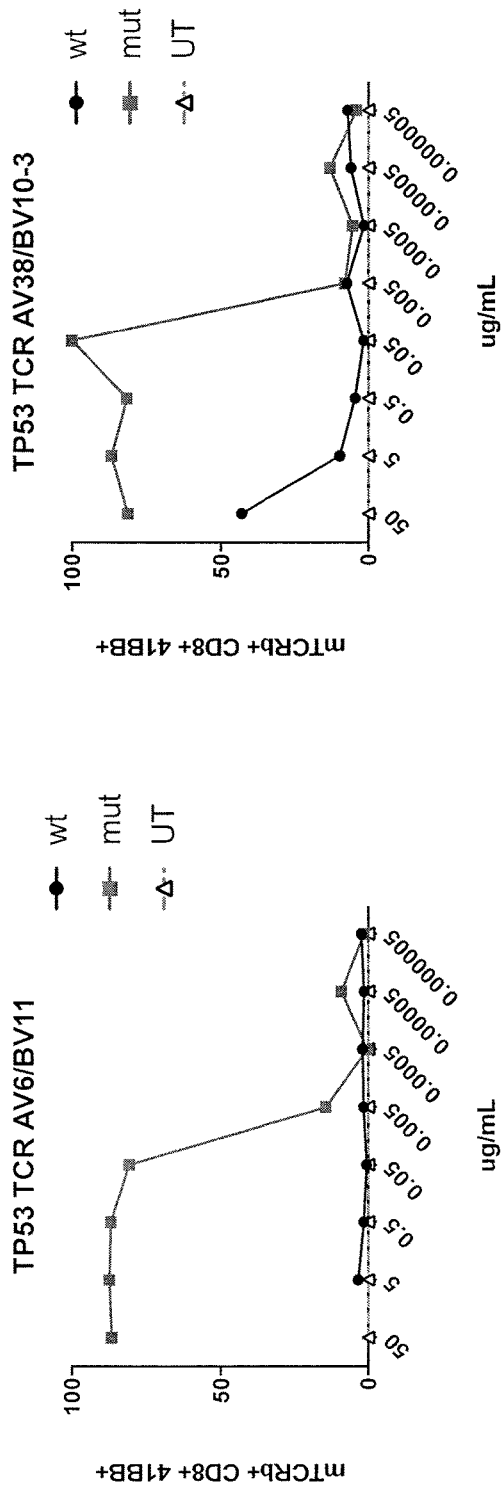
FIG. 9A  FIG. 9B  FIG. 9C  FIG. 9D

```
CLUSTAL O(1.2.4) multiple sequence alignment

SP|P04637|P53_HUMAN      MEEPQSDPSVEPPLSQETFSDLWKLLPENNVLSPLPSQAMDDLMLSPDDIEQWFTEDPGP 60
SP|P04637-2|P53_HUMAN    MEEPQSDPSVEPPLSQETFSDLWKLLPENNVLSPLPSQAMDDLMLSPDDIEQWFTEDPGP 60
SP|P04637-3|P53_HUMAN    MEEPQSDPSVEPPLSQETFSDLWKLLPENNVLSPLPSQAMDDLMLSPDDIEQWFTEDPGP 60
SP|P04637-4|P53_HUMAN    ---------------------------------------MDDLMLSPDDIEQWFTEDPGP 21
SP|P04637-5|P53_HUMAN    ---------------------------------------MDDLMLSPDDIEQWFTEDPGP 21
SP|P04637-6|P53_HUMAN    ---------------------------------------MDDLMLSPDDIEQWFTEDPGP 21
SP|P04637-7|P53_HUMAN    ------------------------------------------------------------
SP|P04637-8|P53_HUMAN    ------------------------------------------------------------
SP|P04637-9|P53_HUMAN    ------------------------------------------------------------

SP|P04637|P53_HUMAN      DEAPRMPEAAPPVAPAPAAPTPAAPAPAPSWPLSSSVPSQKTYQGSYGFRLGFLHSGTAK 120
SP|P04637-2|P53_HUMAN    DEAPRMPEAAPPVAPAPAAPTPAAPAPAPSWPLSSSVPSQKTYQGSYGFRLGFLHSGTAK 120
SP|P04637-3|P53_HUMAN    DEAPRMPEAAPPVAPAPAAPTPAAPAPAPSWPLSSSVPSQKTYQGSYGFRLGFLHSGTAK 120
SP|P04637-4|P53_HUMAN    DEAPRMPEAAPPVAPAPAAPTPAAPAPAPSWPLSSSVPSQKTYQGSYGFRLGFLHSGTAK 81
SP|P04637-5|P53_HUMAN    DEAPRMPEAAPPVAPAPAAPTPAAPAPAPSWPLSSSVPSQKTYQGSYGFRLGFLHSGTAK 81
SP|P04637-6|P53_HUMAN    DEAPRMPEAAPPVAPAPAAPTPAAPAPAPSWPLSSSVPSQKTYQGSYGFRLGFLHSGTAK 81
SP|P04637-7|P53_HUMAN    ------------------------------------------------------------
SP|P04637-8|P53_HUMAN    ------------------------------------------------------------
SP|P04637-9|P53_HUMAN    ------------------------------------------------------------

SP|P04637|P53_HUMAN      SVTCTYSPALNKMFCQLAKTCPVQLWVDSTPPPGTRVRAMAIYKQSQHMTEVVRRCPHHE 180
SP|P04637-2|P53_HUMAN    SVTCTYSPALNKMFCQLAKTCPVQLWVDSTPPPGTRVRAMAIYKQSQHMTEVVRRCPHHE 180
SP|P04637-3|P53_HUMAN    SVTCTYSPALNKMFCQLAKTCPVQLWVDSTPPPGTRVRAMAIYKQSQHMTEVVRRCPHHE 180
SP|P04637-4|P53_HUMAN    SVTCTYSPALNKMFCQLAKTCPVQLWVDSTPPPGTRVRAMAIYKQSQHMTEVVRRCPHHE 141
SP|P04637-5|P53_HUMAN    SVTCTYSPALNKMFCQLAKTCPVQLWVDSTPPPGTRVRAMAIYKQSQHMTEVVRRCPHHE 141
SP|P04637-6|P53_HUMAN    SVTCTYSPALNKMFCQLAKTCPVQLWVDSTPPPGTRVRAMAIYKQSQHMTEVVRRCPHHE 141
SP|P04637-7|P53_HUMAN    ------------MFCQLAKTCPVQLWVDSTPPPGTRVRAMAIYKQSQHMTEVVRRCPHHE 48
SP|P04637-8|P53_HUMAN    ------------MFCQLAKTCPVQLWVDSTPPPGTRVRAMAIYKQSQHMTEVVRRCPHHE 48
SP|P04637-9|P53_HUMAN    ------------MFCQLAKTCPVQLWVDSTPPPGTRVRAMAIYKQSQHMTEVVRRCPHHE 48
                                     ************************************************

SP|P04637|P53_HUMAN      RCSDSDGLAPPQHLIRVEGNLRVEYLDDRNTFRHSVVVPYEPPEVGSDCTTIHYNYMCNS 240
SP|P04637-2|P53_HUMAN    RCSDSDGLAPPQHLIRVEGNLRVEYLDDRNTFRHSVVVPYEPPEVGSDCTTIHYNYMCNS 240
SP|P04637-3|P53_HUMAN    RCSDSDGLAPPQHLIRVEGNLRVEYLDDRNTFRHSVVVPYEPPEVGSDCTTIHYNYMCNS 240
SP|P04637-4|P53_HUMAN    RCSDSDGLAPPQHLIRVEGNLRVEYLDDRNTFRHSVVVPYEPPEVGSDCTTIHYNYMCNS 201
SP|P04637-5|P53_HUMAN    RCSDSDGLAPPQHLIRVEGNLRVEYLDDRNTFRHSVVVPYEPPEVGSDCTTIHYNYMCNS 201
SP|P04637-6|P53_HUMAN    RCSDSDGLAPPQHLIRVEGNLRVEYLDDRNTFRHSVVVPYEPPEVGSDCTTIHYNYMCNS 201
SP|P04637-7|P53_HUMAN    RCSDSDGLAPPQHLIRVEGNLRVEYLDDRNTFRHSVVVPYEPPEVGSDCTTIHYNYMCNS 108
SP|P04637-8|P53_HUMAN    RCSDSDGLAPPQHLIRVEGNLRVEYLDDRNTFRHSVVVPYEPPEVGSDCTTIHYNYMCNS 108
SP|P04637-9|P53_HUMAN    RCSDSDGLAPPQHLIRVEGNLRVEYLDDRNTFRHSVVVPYEPPEVGSDCTTIHYNYMCNS 108
                         ************************************************************

SP|P04637|P53_HUMAN      SCMGGMNRRPILTIITLEDSSGNLLGRNSFEVRVCACPGRDRRTEEENLRKKGEPHHELP 300
SP|P04637-2|P53_HUMAN    SCMGGMNRRPILTIITLEDSSGNLLGRNSFEVRVCACPGRDRRTEEENLRKKGEPHHELP 300
SP|P04637-3|P53_HUMAN    SCMGGMNRRPILTIITLEDSSGNLLGRNSFEVRVCACPGRDRRTEEENLRKKGEPHHELP 300
SP|P04637-4|P53_HUMAN    SCMGGMNRRPILTIITLEDSSGNLLGRNSFEVRVCACPGRDRRTEEENLRKKGEPHHELP 261
SP|P04637-5|P53_HUMAN    SCMGGMNRRPILTIITLEDSSGNLLGRNSFEVRVCACPGRDRRTEEENLRKKGEPHHELP 261
SP|P04637-6|P53_HUMAN    SCMGGMNRRPILTIITLEDSSGNLLGRNSFEVRVCACPGRDRRTEEENLRKKGEPHHELP 261
SP|P04637-7|P53_HUMAN    SCMGGMNRRPILTIITLEDSSGNLLGRNSFEVRVCACPGRDRRTEEENLRKKGEPHHELP 168
SP|P04637-8|P53_HUMAN    SCMGGMNRRPILTIITLEDSSGNLLGRNSFEVRVCACPGRDRRTEEENLRKKGEPHHELP 168
SP|P04637-9|P53_HUMAN    SCMGGMNRRPILTIITLEDSSGNLLGRNSFEVRVCACPGRDRRTEEENLRKKGEPHHELP 168
                         ************************************************************

SP|P04637|P53_HUMAN      PGSTKRALPNNTSSSPQPKKKPLDGEYFTLQIRGRERFEMFRELNEALELKDAQAGKEPG 360
SP|P04637-2|P53_HUMAN    PGSTKRALPNNTSSSPQPKKKPLDGEYFTLQDQTSFQKENC------------------ 341
SP|P04637-3|P53_HUMAN    PGSTKRALPNNTSSSPQPKKKPLDGEYFTLQMLLDLRWCYFLINSS-------------- 346
SP|P04637-4|P53_HUMAN    PGSTKRALPNNTSSSPQPKKKPLDGEYFTLQIRGRERFEMFRELNEALELKDAQAGKEPG 321
SP|P04637-5|P53_HUMAN    PGSTKRALPNNTSSSPQPKKKPLDGEYFTLQDQTSFQKENC------------------ 302
SP|P04637-6|P53_HUMAN    PGSTKRALPNNTSSSPQPKKKPLDGEYFTLQMLLDLRWCYFLINSS-------------- 307
SP|P04637-7|P53_HUMAN    PGSTKRALPNNTSSSPQPKKKPLDGEYFTLQIRGRERFEMFRELNEALELKDAQAGKEPG 228
SP|P04637-8|P53_HUMAN    PGSTKRALPNNTSSSPQPKKKPLDGEYFTLQDQTSFQKENC------------------ 209
SP|P04637-9|P53_HUMAN    PGSTKRALPNNTSSSPQPKKKPLDGEYFTLQMLLDLRWCYFLINSS-------------- 214
                         *******************************               :

SP|P04637|P53_HUMAN      GSRAHSSHLKSKKGQSTSRHKKLMFKTEGPDSD 393
SP|P04637-2|P53_HUMAN    --------------------------------
SP|P04637-3|P53_HUMAN    --------------------------------
SP|P04637-4|P53_HUMAN    GSRAHSSHLKSKKGQSTSRHKKLMFKTEGPDSD 354
SP|P04637-5|P53_HUMAN    --------------------------------
SP|P04637-6|P53_HUMAN    --------------------------------
SP|P04637-7|P53_HUMAN    GSRAHSSHLKSKKGQSTSRHKKLMFKTEGPDSD 261
SP|P04637-8|P53_HUMAN    --------------------------------
SP|P04637-9|P53_HUMAN    --------------------------------
```

FIG. 35

T CELL RECEPTORS RECOGNIZING MUTATED P53

CROSS-REFERENCE TO RELATED APPLICATION

This patent application is the U.S. national stage of PCT/US2018/051285, filed Sep. 17, 2018, which claims the benefit of U.S. Provisional Patent Application No. 62/565,383, filed Sep. 29, 2017, which is incorporated by reference in its entirety herein.

STATEMENT REGARDING FEDERALLY SPONSORED RESEARCH OR DEVELOPMENT

This invention was made with Government support under project number BC010985 by the National Institutes of Health, National Cancer Institute. The Government has certain rights in the invention.

INCORPORATION-BY-REFERENCE OF MATERIAL SUBMITTED ELECTRONICALLY

Incorporated by reference in its entirety herein is a computer-readable nucleotide/amino acid sequence listing submitted concurrently herewith and identified as follows: One 687,602 Byte ASCII (Text) file named "748357_ST25.txt" dated Mar. 26, 2020.

BACKGROUND OF THE INVENTION

Some cancers may have very limited treatment options, particularly when the cancer becomes metastatic and unresectable. Despite advances in treatments such as, for example, surgery, chemotherapy, and radiation therapy, the prognosis for many cancers, such as, for example, pancreatic, colorectal, lung, endometrial, ovarian, and prostate cancers, may be poor. Accordingly, there exists an unmet need for additional treatments for cancer.

BRIEF SUMMARY OF THE INVENTION

An embodiment of the invention provides an isolated or purified T cell receptor (TCR) having antigenic specificity for mutated human p53.

Further embodiments of the invention provide related polypeptides and proteins, as well as related nucleic acids, recombinant expression vectors, host cells, populations of cells, and pharmaceutical compositions relating to the TCRs of the invention.

Still further embodiments of the invention provide methods of detecting the presence of cancer in a mammal and methods of treating or preventing cancer in a mammal.

BRIEF DESCRIPTION OF THE SEVERAL VIEWS OF THE DRAWINGS

FIGS. 9A-9D are graphs showing the percentages of mTCRβ+CD8+41BB+ cells detected following co-culture of DCs pulsed with minimal WT (circles) or mutated (mut) (squares) epitope at the indicated concentrations (μg/mL) with cells transduced with one of the following TCRs: AV12/BV6-1 (A), AV2/BV6-1 (B), AV6/BV11 (C), or AV38/BV10-3 (D). Co-culture of pulsed DCs with untransduced (UT) cells (triangles) served as a control. Results shown are representative of two experiments.

sequence. Secretion of IFN-γ is shown by open bars. Expression of 4-1BB is shown by closed bars.

Figure 27:
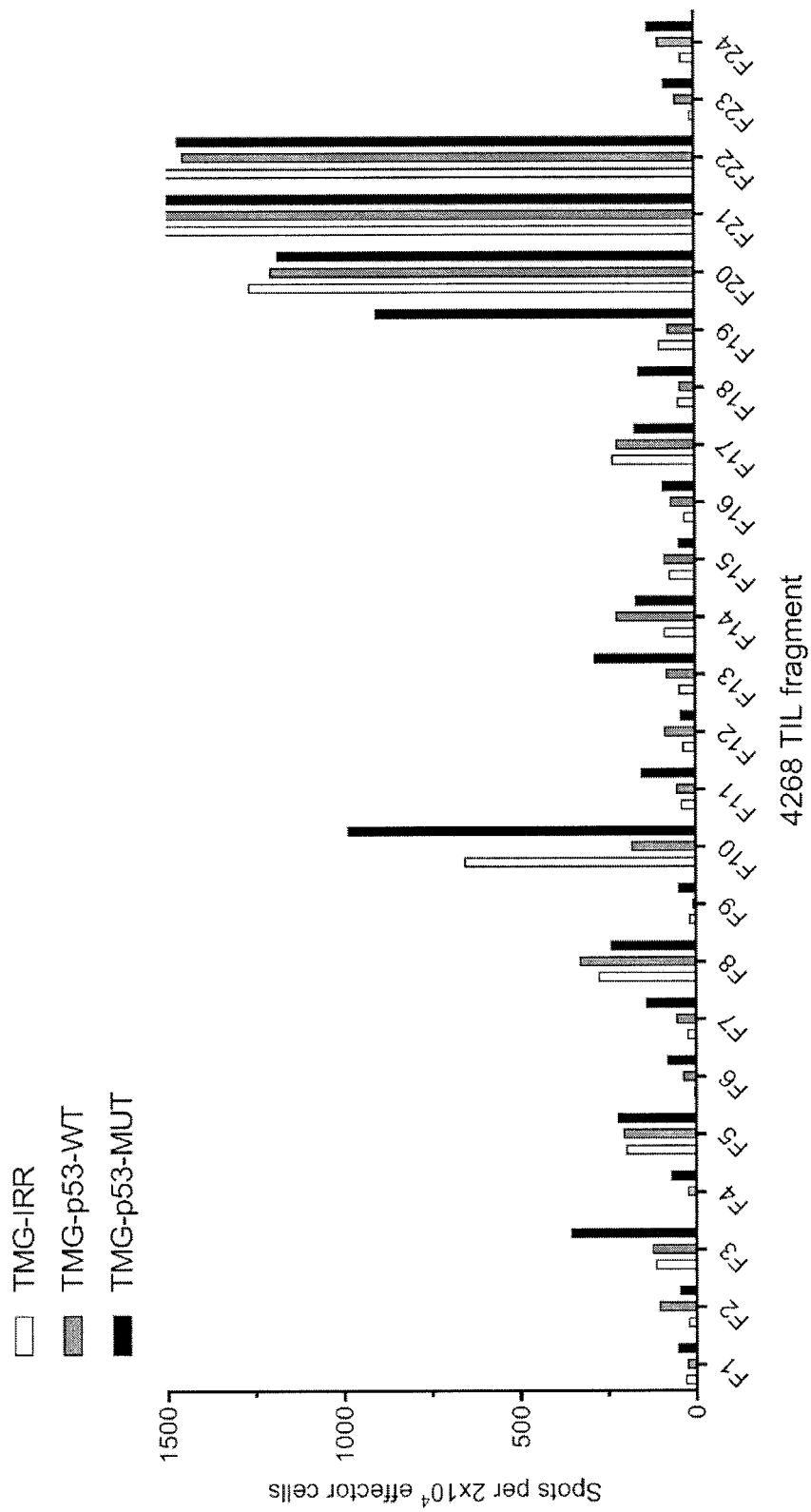

FIG. 27 is a graph showing the number of IFN-γ-positive spots per $2 \times 10^4$ effector cells measured following co-culture of TIL fragments (F1-F24, n=24) from patient 4268 with autologous APCs electroporated with TMG composed of irrelevant (IRR; open bars), WT p53 (p53-WT; gray bars), or mutated p53 (p53-MUT; black bars) sequence.

Figure 28:
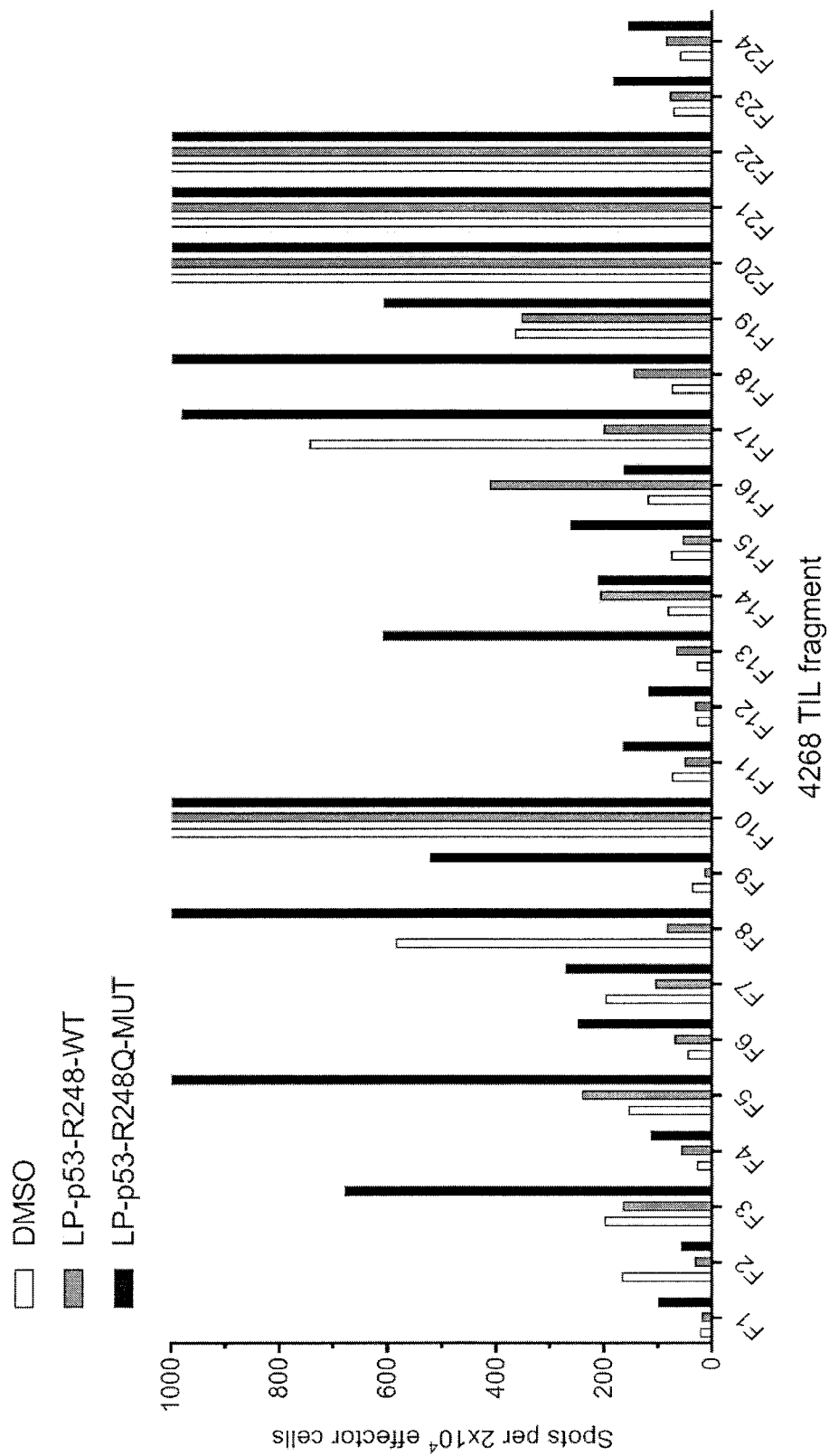

FIG. 28 is a graph showing the number of IFN-γ-positive spots per $2 \times 10^4$ effector cells measured following co-culture of TIL fragments (F1-F24, n=24) from patient 4268 with autologous APCs pulsed with peptide vehicle (DMSO; open bars) or purified (>95% by HPLC) 25-amino acid peptides composed of WT p53-R248 sequence (LP-p53-R248-WT; gray bars) or mutated p53-R248Q (LP-p53-R248Q-MUT; black bars) sequence.

Figure 29:
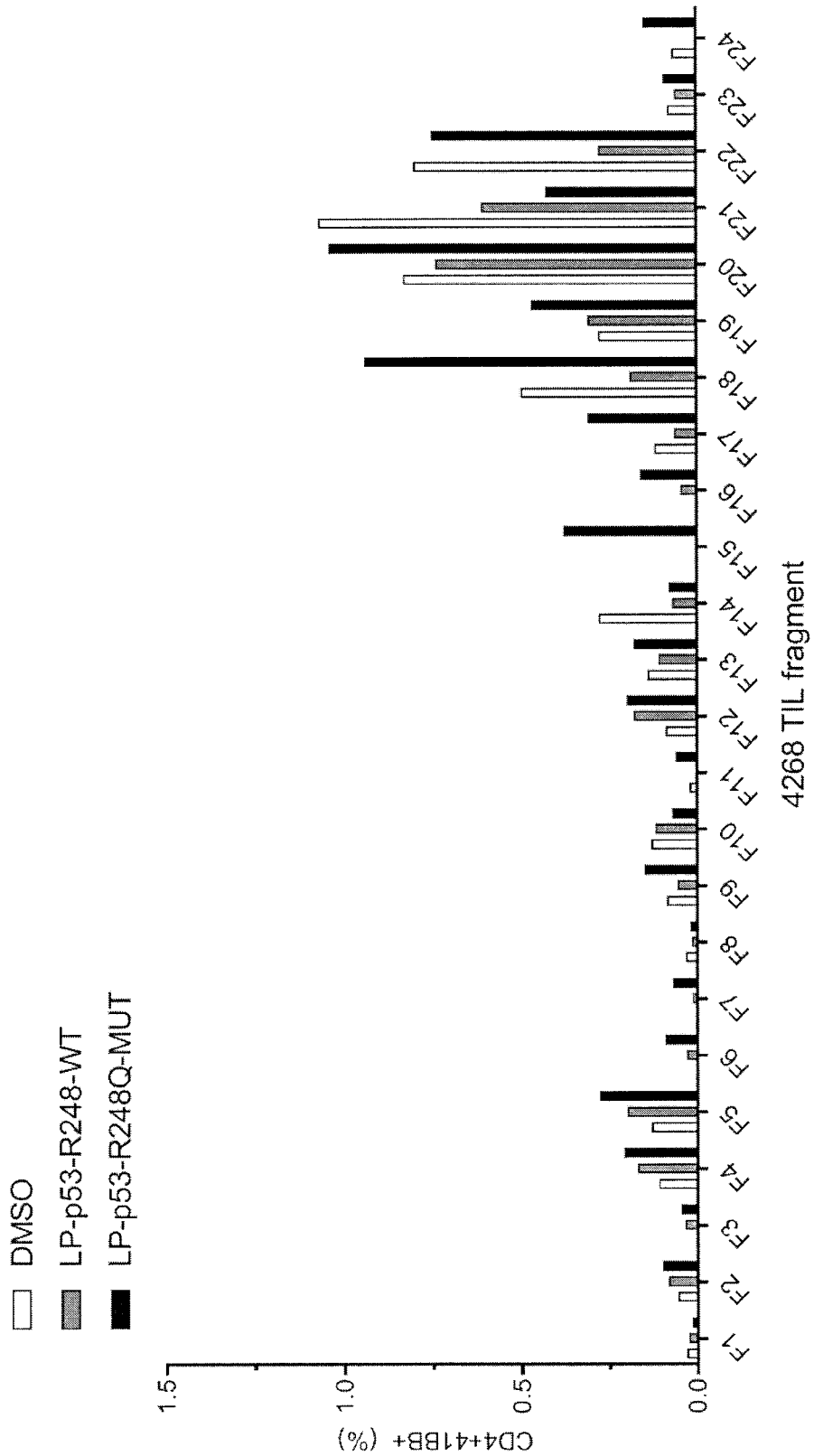

FIG. 29 is a graph showing the percentage of CD4+4-1BB+ cells detected following co-culture of TIL fragments (F1-F24, n=24) from patient 4268 with autologous APCs pulsed with peptide vehicle (DMSO; open bars) or purified (>95% by HPLC) 25-amino acid peptides composed of WT p53-R248 sequence (LP-p53-R248-WT; gray bars) or mutated p53-R248Q (LP-p53-R248Q-MUT; black bars) sequence.

Figure 30:
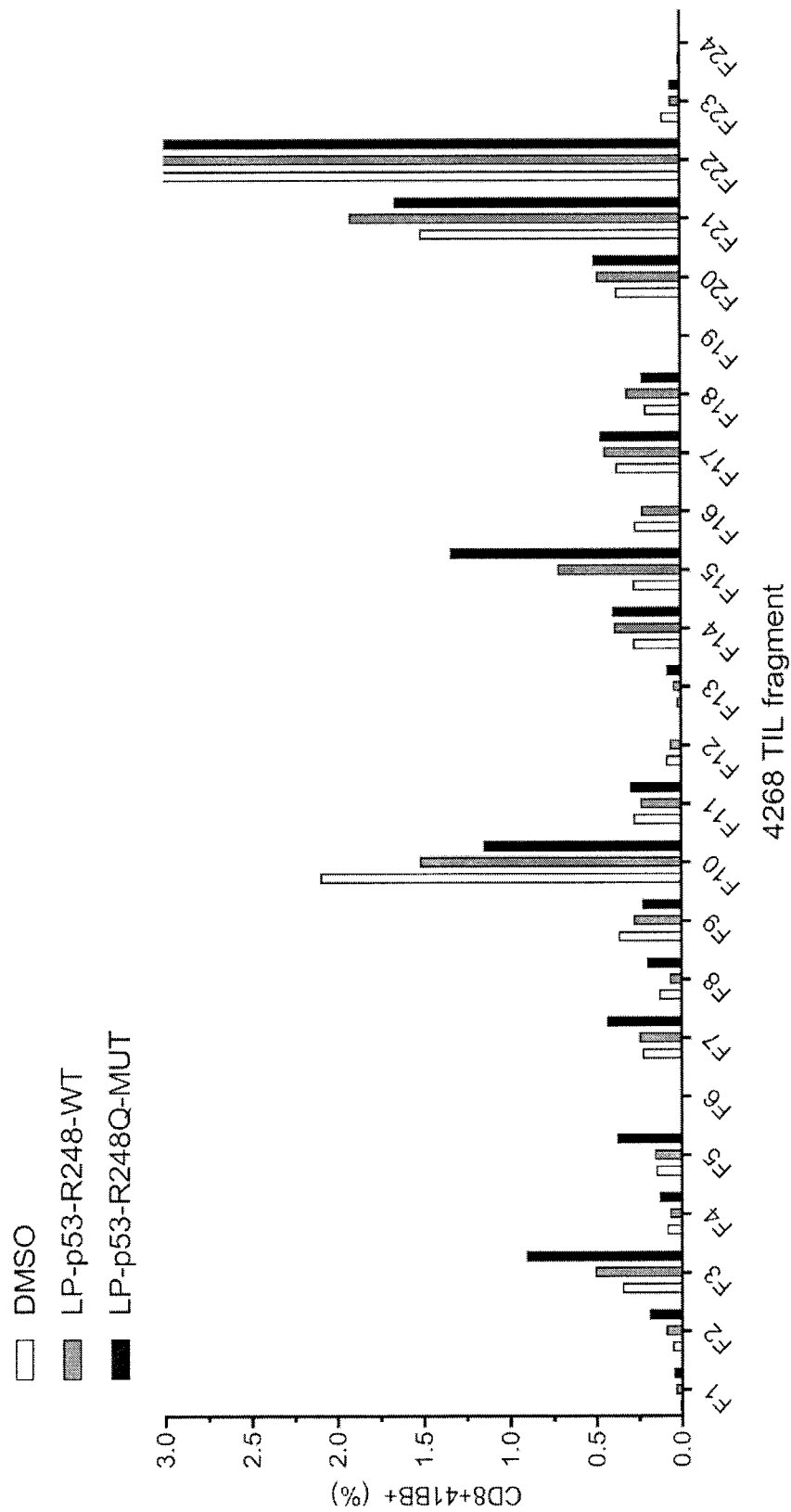

FIG. 30 is a graph showing the percentage of CD8+4-1 BB+ cells detected following co-culture of TIL fragments (F1-F24, n=24) from patient 4268 with autologous APCs pulsed with peptide vehicle (DMSO; open bars) or purified (>95% by HPLC) 25-amino acid peptides composed of WT p53-R248 sequence (LP-p53-R248-WT; gray bars) or mutated p53-R248Q (LP-p53-R248Q-MUT; black bars) sequence.

Figure 31:
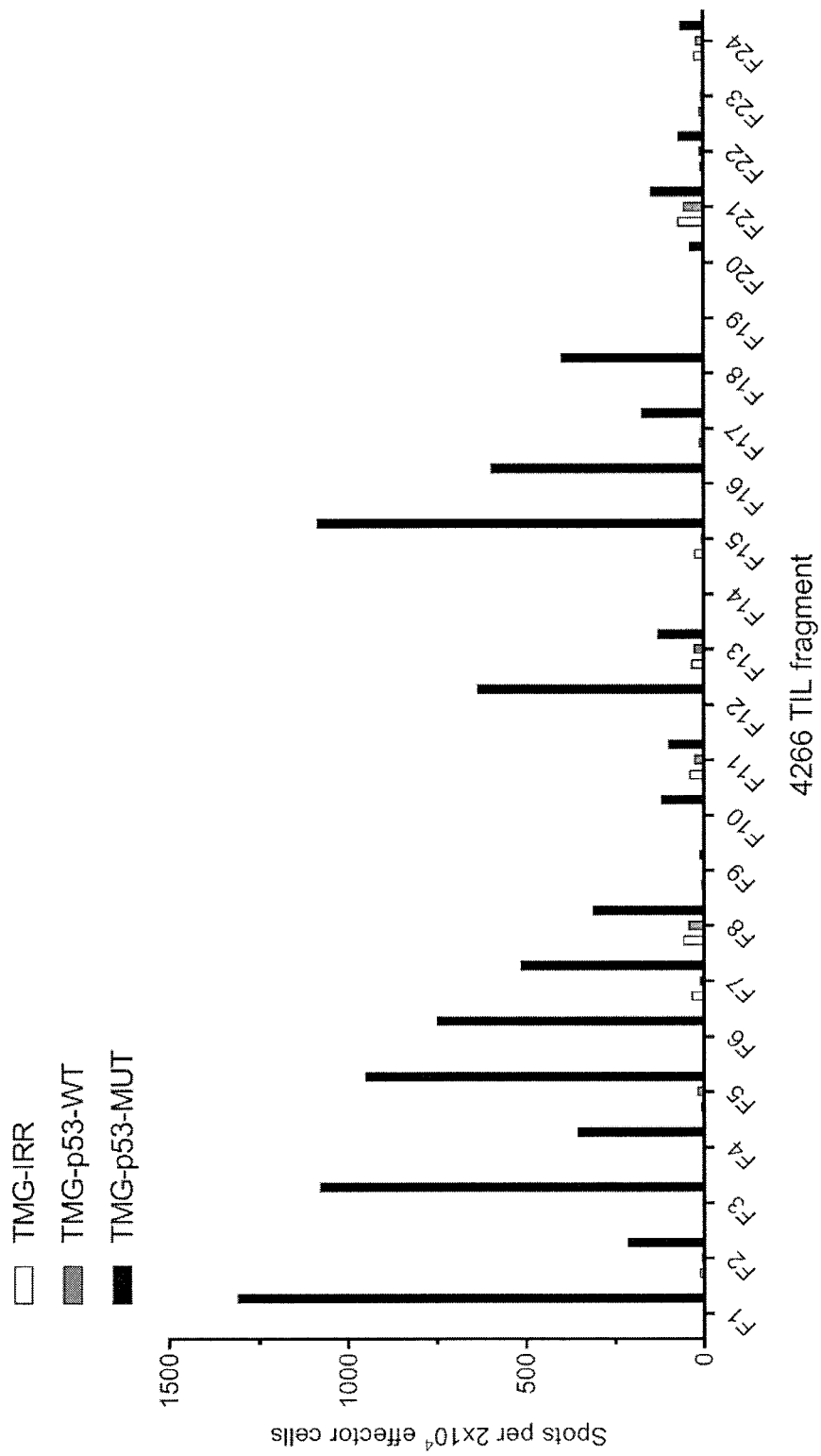

FIG. 31 is a graph showing the number of IFN-γ-positive spots per $2 \times 10^4$ effector cells measured following co-culture of TIL fragments (F1-F24, n=24) from patient 4266 with autologous APCs electroporated with TMG composed of irrelevant (IRR; open bars), WT p53 (p53-WT; gray bars), or mutated p53 (p53-MUT; black bars) sequence.

Figure 32:
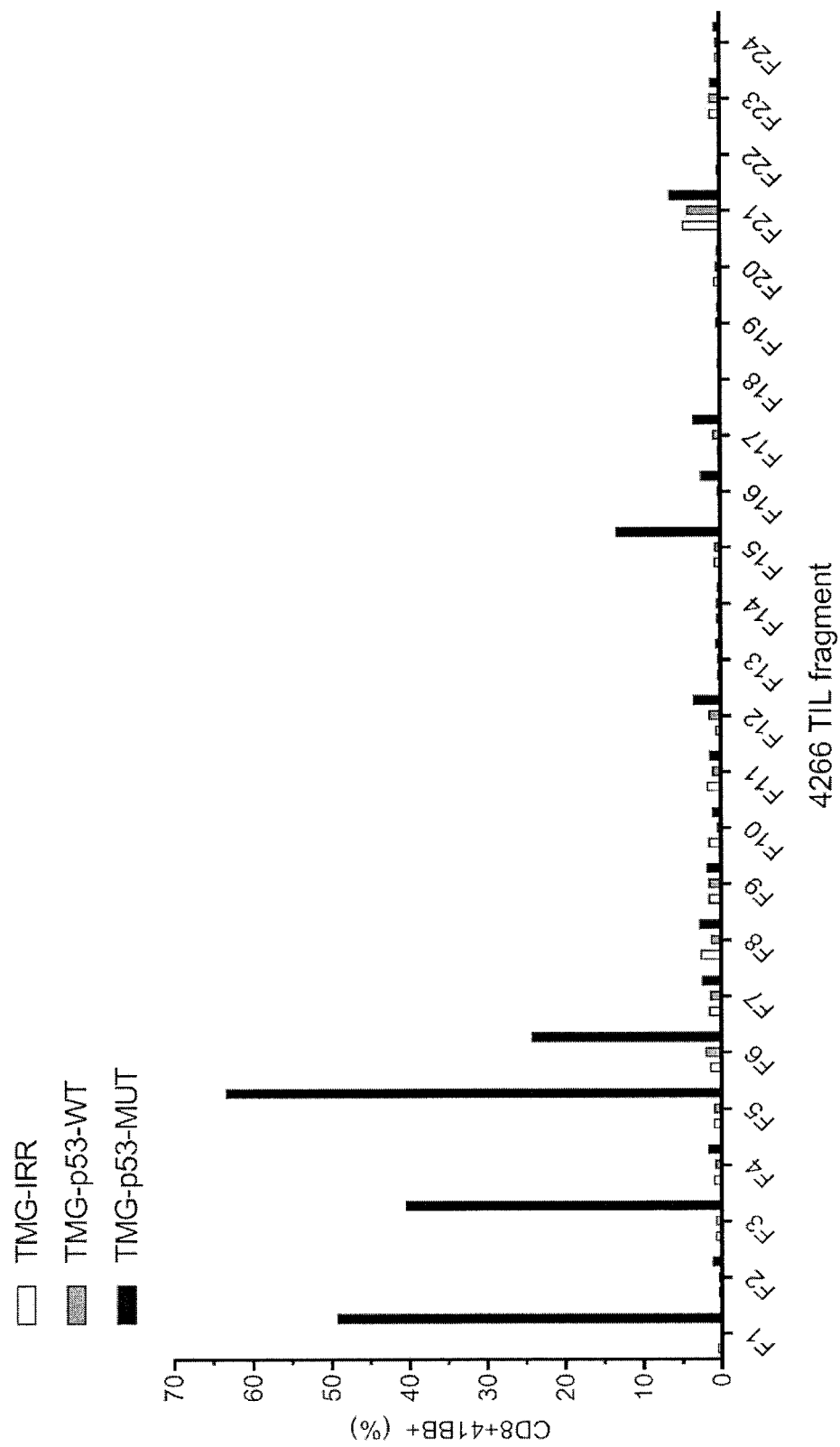

FIG. 32 is a graph showing the percentage of CD8+4-1BB+ cells detected following co-culture of TIL fragments (F1-F24, n=24) from patient 4266 with autologous APCs electroporated with TMG composed of irrelevant (IRR; open bars), WT p53 (p53-WT; gray bars), or mutated p53 (p53-MUT; black bars) sequence.

Figure 33:
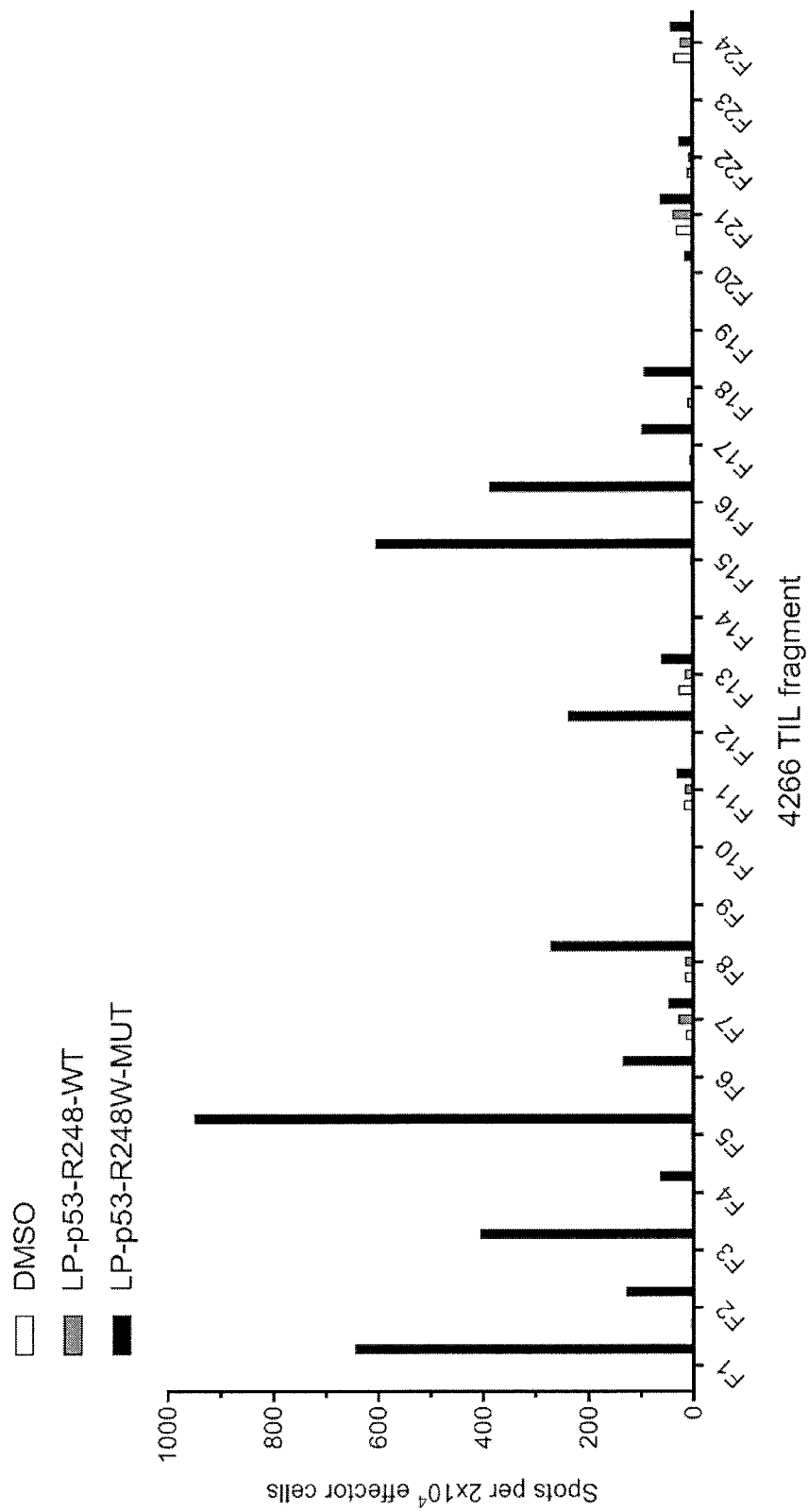

FIG. 33 is a graph showing the number of IFN-γ-positive spots per $2 \times 10^4$ effector cells measured following co-culture of TIL fragments (F1-F24, n=24) from patient 4266 with autologous APCs pulsed with peptide vehicle (DMSO; open bars) or purified (>95% by HPLC) 25-amino acid peptides composed of WT p53-R248 sequence (LP-p53-R248-WT; gray bars) or mutated p53-R248W (LP-p53-R248W-MUT; black bars) sequence.

Figure 34:
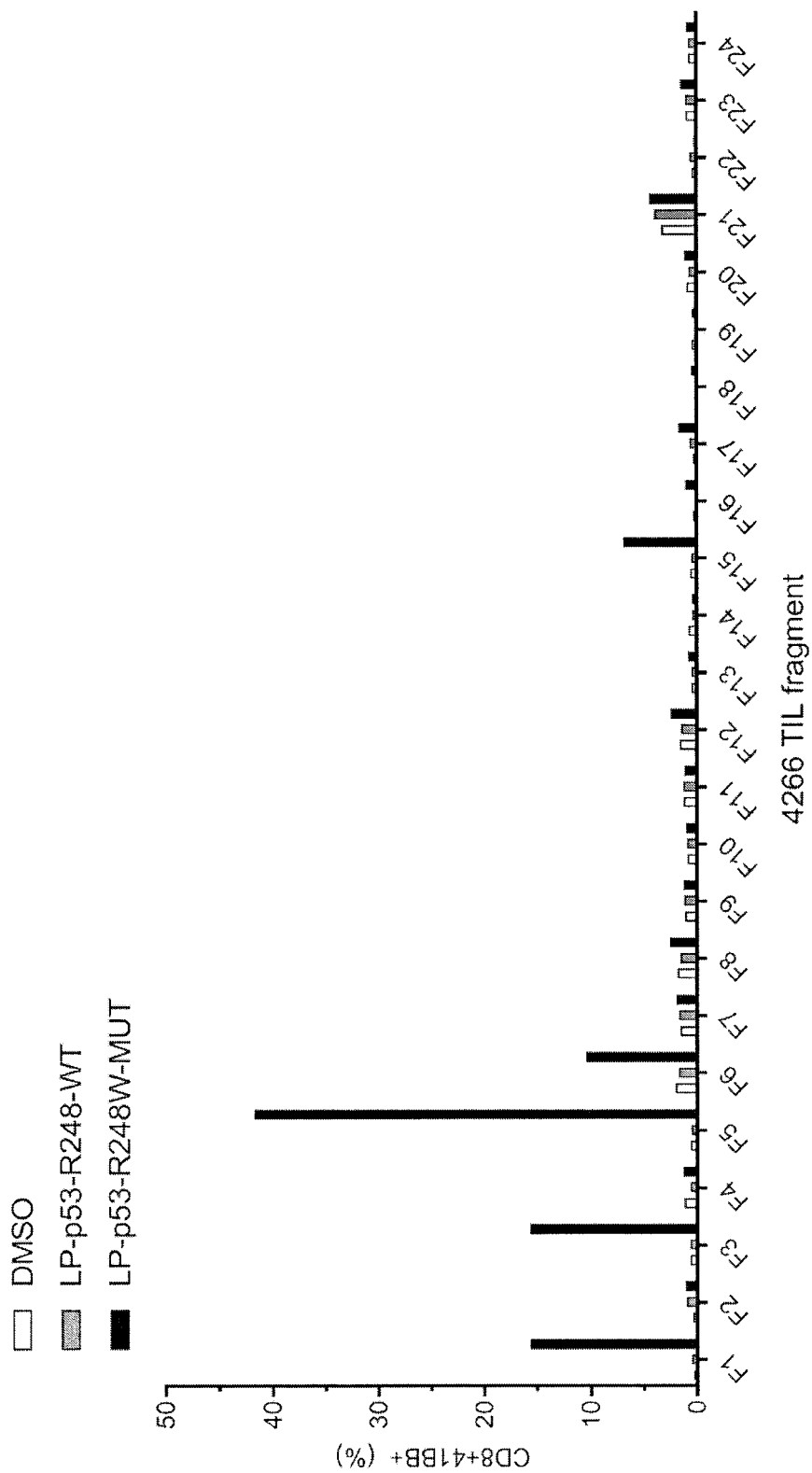

FIG. 34 is a graph showing the percentage of CD8+4-1BB+ cells detected following co-culture of TIL fragments (F1-F24, n=24) from patient 4266 with autologous APCs pulsed with peptide vehicle (DMSO; open bars) or purified (>95% by HPLC) 25-amino acid peptides composed of WT p53-R248 sequence (LP-p53-R248-WT; gray bars) or mutated p53-R248W (LP-p53-R248W-MUT; black bars) sequence.

FIG. 35 shows an alignment of the amino acid sequences of the nine p53 splice variants. SP|P04637|P53_HUMAN (SEQ ID NO: 1); SP|P04637-2|P53_HUMAN (SEQ ID NO: 535); SP|P04637-3|P53_HUMAN (SEQ ID NO: 536); SP|P04637-4|P53_HUMAN (SEQ ID NO: 537); SP|P04637-5|P53_HUMAN (SEQ ID NO: 538); SP|P04637-6|P53_HUMAN (SEQ ID NO: 539); SP|P04637-7|P53_HUMAN (SEQ ID NO: 540); SP|P04637-8|P53_HUMAN (SEQ ID NO: 541); and SP|P04637-9|P53_HUMAN (SEQ ID NO: 542).

Figure 36:
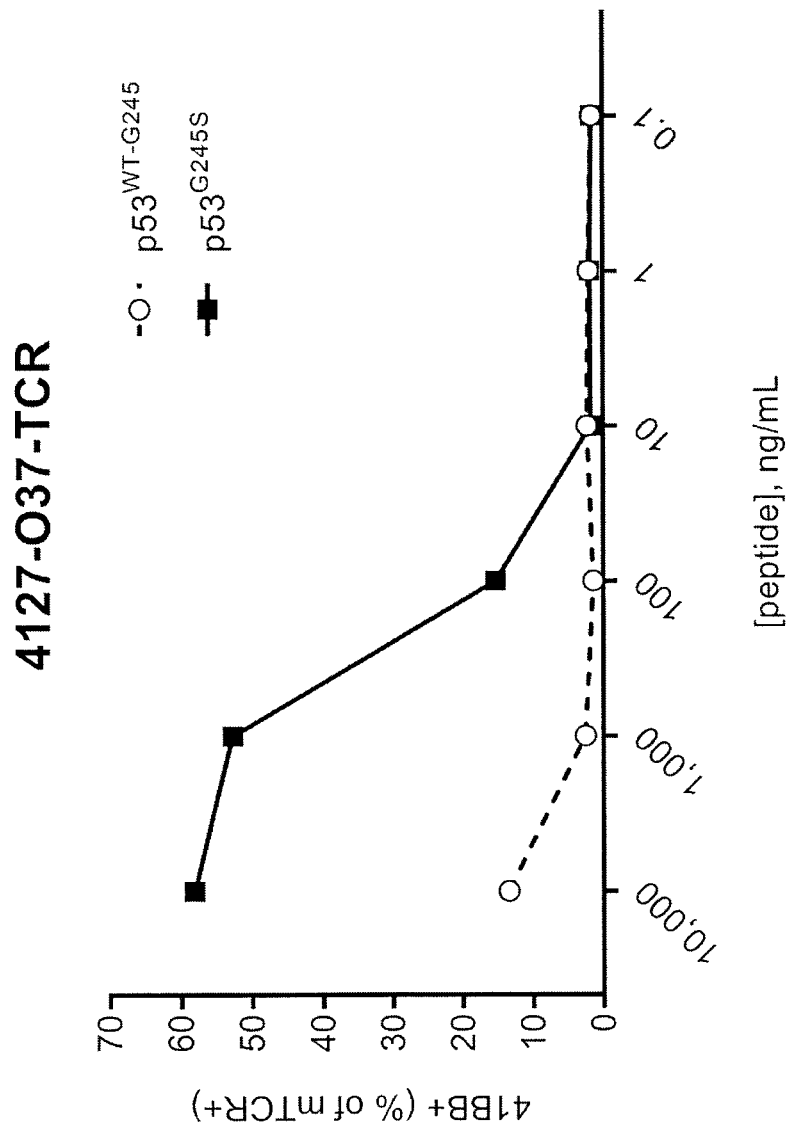

FIG. 36 is a graph showing the percentage of 4-1 BB positive cells (% of mTCRβ+) detected following co-culture of T cells transduced with the 4127-O37-TCR with autologous APCs pulsed with decreasing concentrations of 25-amino acid peptides corresponding to the WT (open circles) or mutated (closed squares) p53-G245S sequence.

Figure 37A:
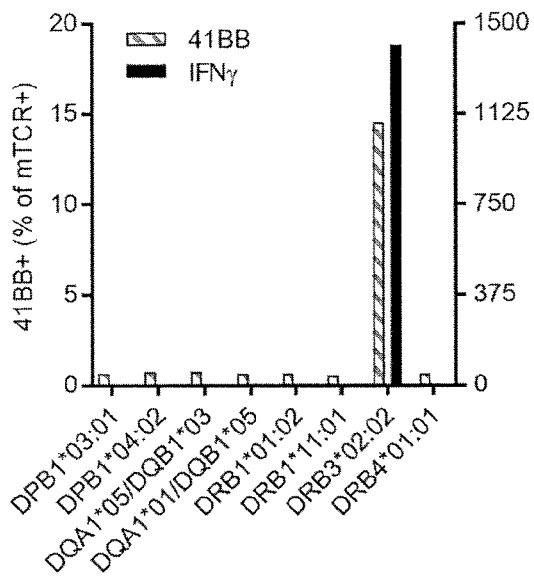
Figure 37B:
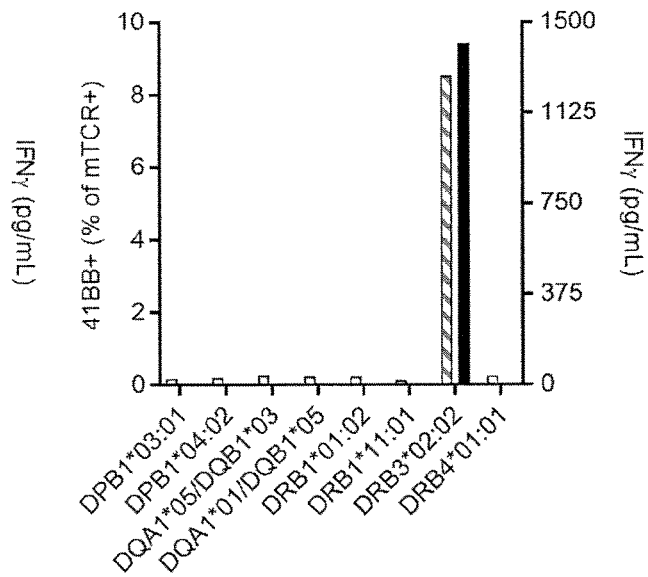
Figure 37C:
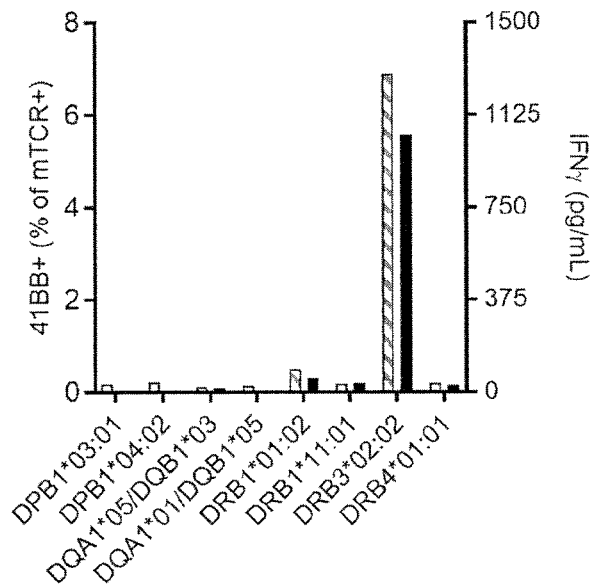

FIGS. 37A-37C are graphs showing percentage of 4-1BB positive cells (% of mTCRβ+) (left y-axis; hatched bars) and IFN-γ (pg/mL) (right y-axis; black bars) measured following co-culture of T cells transduced with the 4127-O37-TCR (A), 4127-TP53-G245S-TCR1 (B), or 4127-O102-TCR (C) with COS7 cells co-transfected with one of the indicated HLA alleles and pulsed with the 25-amino acid p53-G245S peptide.

Figure 38:
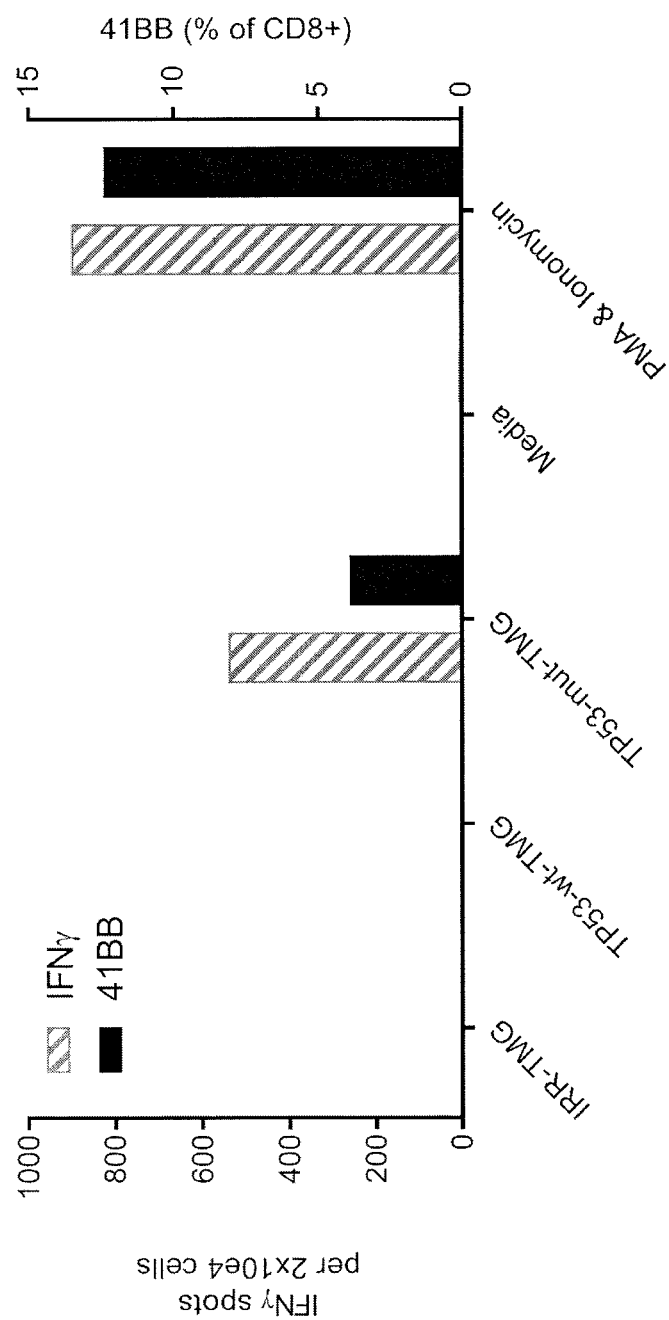

FIG. 38 is a graph showing the percentage of 4-1BB positive cells (% of CD8+) (right y-axis; black bars) and IFN-γ (spots per $2 \times 10^4$ cells) (left y-axis; hatched bars) measured following co-culture of TIL from Patient 4141 (fragment culture 12) with autologous APCs transfected with TMG encoding irrelevant mutations (TMG-IRR), WT p53 sequence (TP53-wt-TMG) or mutated p53 sequence including R175H (TP53-mut-TMG). Media alone and PMA and ionomycin were negative and positive controls, respectively.

Figure 39:
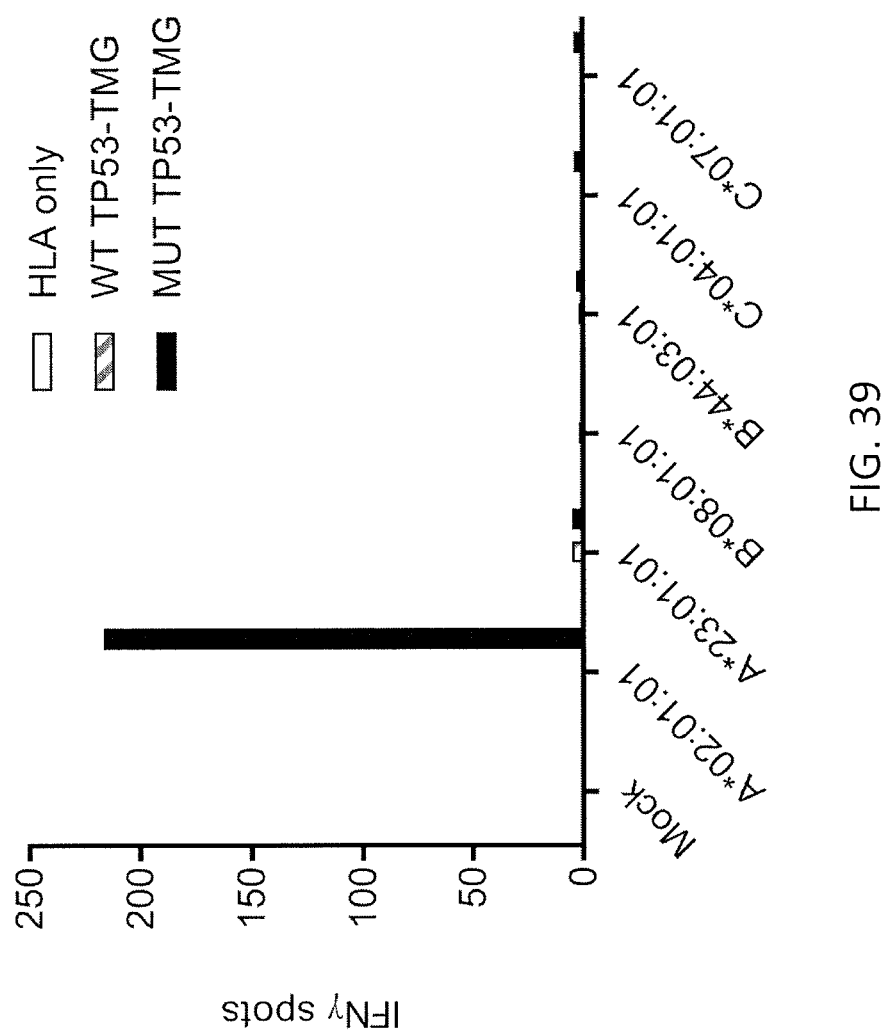

FIG. 39 is a graph showing the number of IFN-γ-positive spots per $2 \times 10^4$ effector cells measured following co-culture of TIL from Patient 4141 (fragment culture 12) with Cos 7 cells co-transfected with the indicated HLA alleles and either no extra gene (HLA only; open bars), WT TP53 TMG (gray hatched bars), or mutated (black bars) TP53 TMG containing the p53-R175H sequence.

Figure 40:
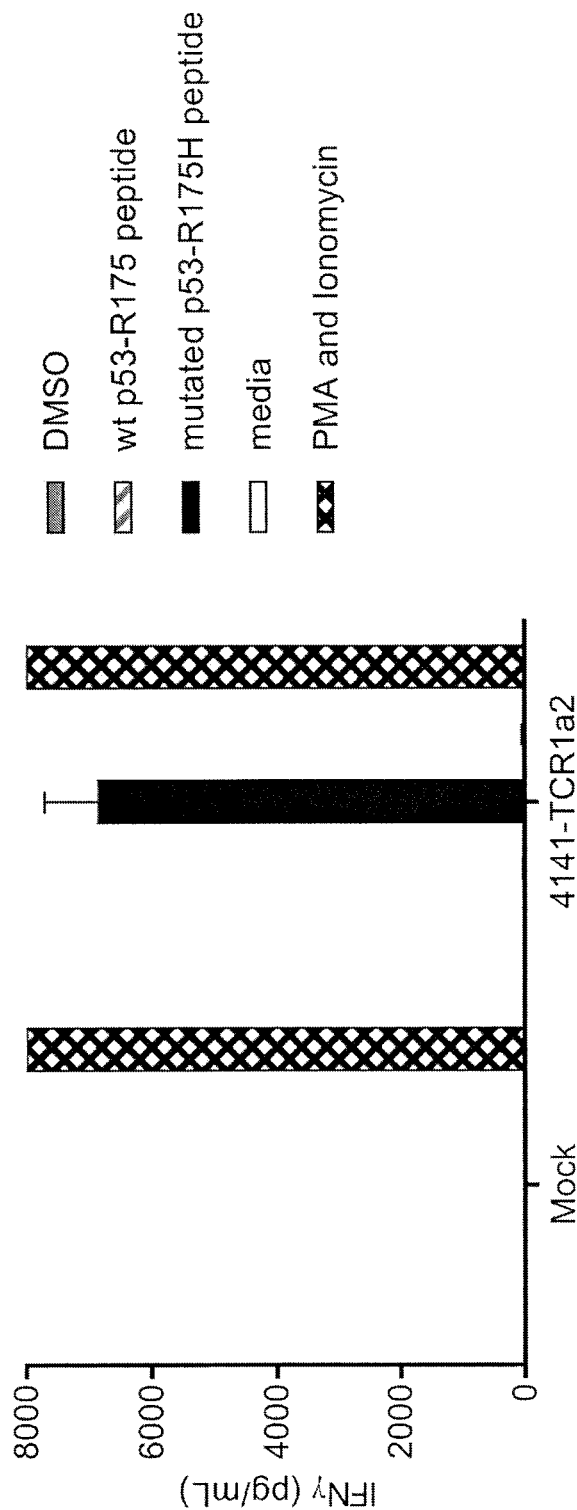

FIG. 40 is a graph showing the concentration of IFN-γ (pg/mL) measured following co-culture of T cells expressing mock (no TCR) or 4141-TCR1a2 with T2 tumor cells (expressing HLA-A*02:01). T2 cells were pulsed with peptide vehicle (DMSO; gray bars) or purified (>95% by HPLC) peptides composed of WT p53-R175 peptide (hatched gray bars) or mutated p53-R175H peptide (black bars). Media alone (open bars) and PMA and Ionomycin (lattice bars) were negative and positive controls, respectively. Data are mean±SEM (n=3).

Figure 41:
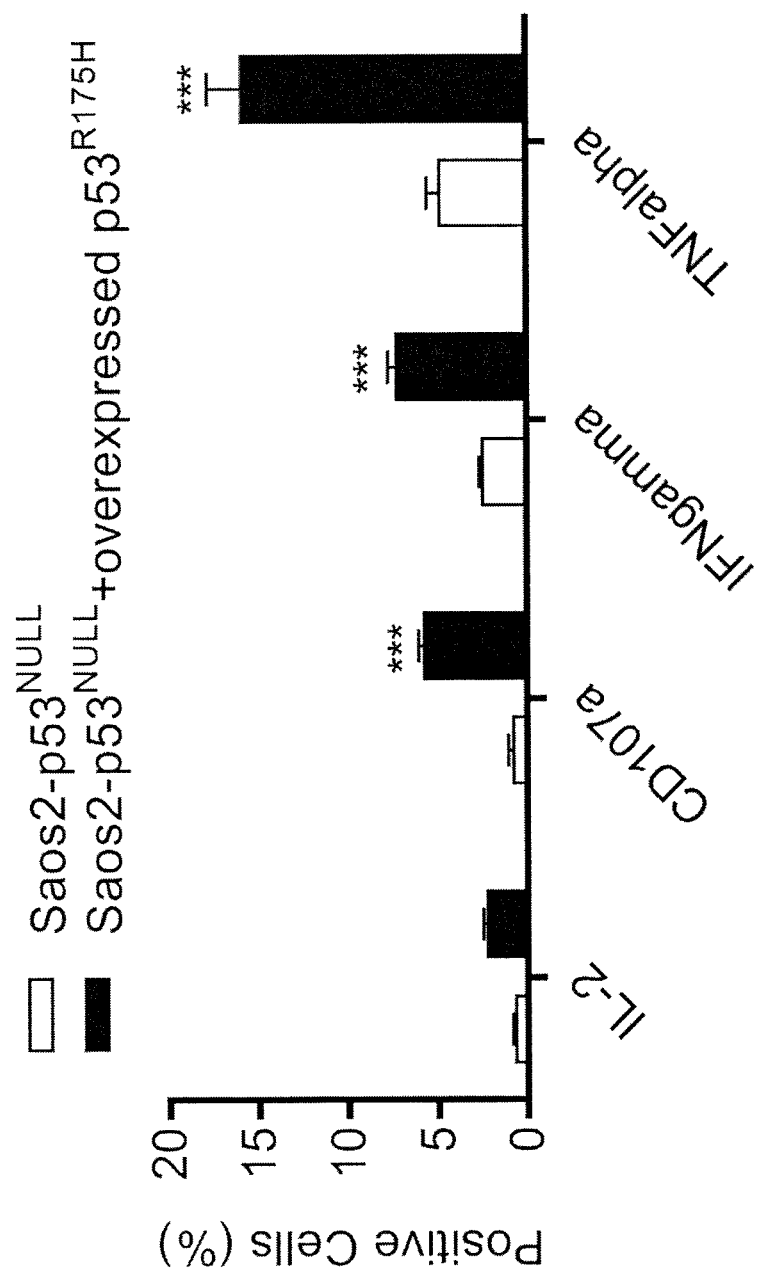

FIG. 41 is a graph showing the percentage of cells positive for expression of one of the indicated markers following co-culture of T cells expressing 4141-TCR1a2 with Saos2 cells (p53-NULL and HLA-A*02:01+), which were either unmanipulated (unshaded bars) or made to overexpress full length p53-R175H protein (shaded bars). Data are mean±SEM (n=3). Student's two-tailed t-tests were performed for each cytokine between the two cell lines for statistical analyses (***$p<0.001$).

Figure 42:
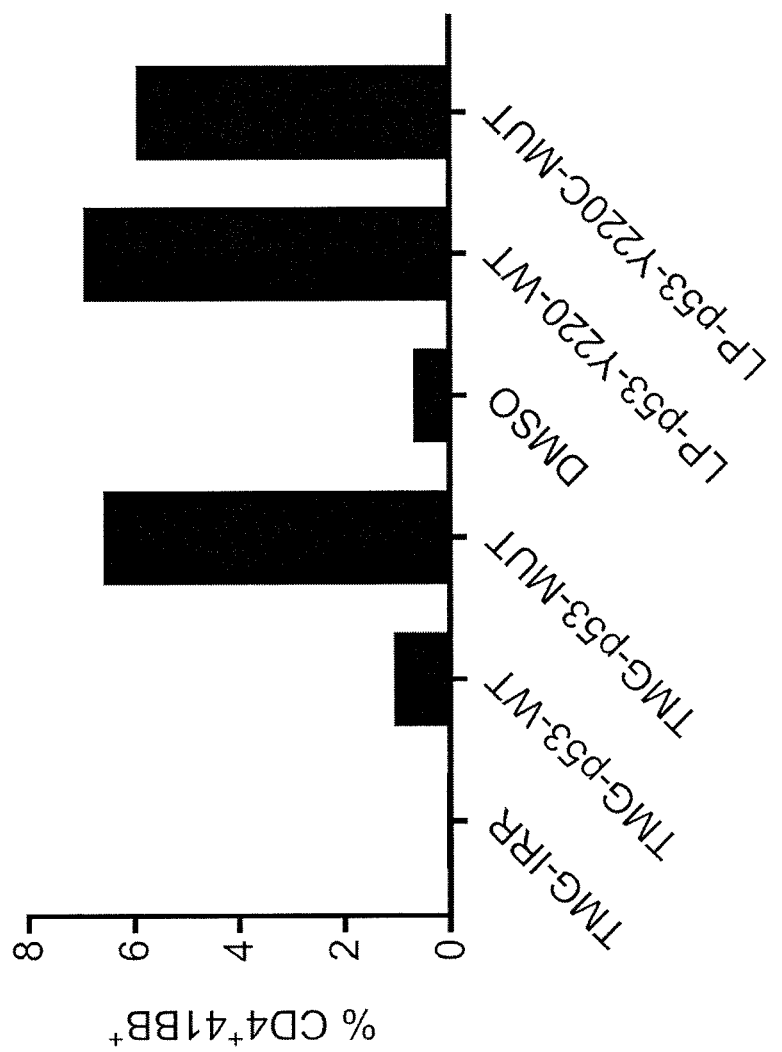

FIG. 42 is a graph showing the percentage of CD4+4-1 BB positive cells detected following co-culture of TIL (fragment culture 6 from patient 4259) with autologous APCs either (1) electroporated with TMG composed of irrelevant (TMG-IRR), WT p53 (TMG-p53-WT) or mutated p53 (TMG-p53-MUT) sequence or (2) pulsed with peptide vehicle (DMSO) or purified (>95% by HPLC) 25-amino acid peptides composed of WT p53-Y220 sequence (LP-p53-Y220-WT) or mutated p53-Y220C (LP-p53-Y220C-MUT) sequence.

Figure 43:
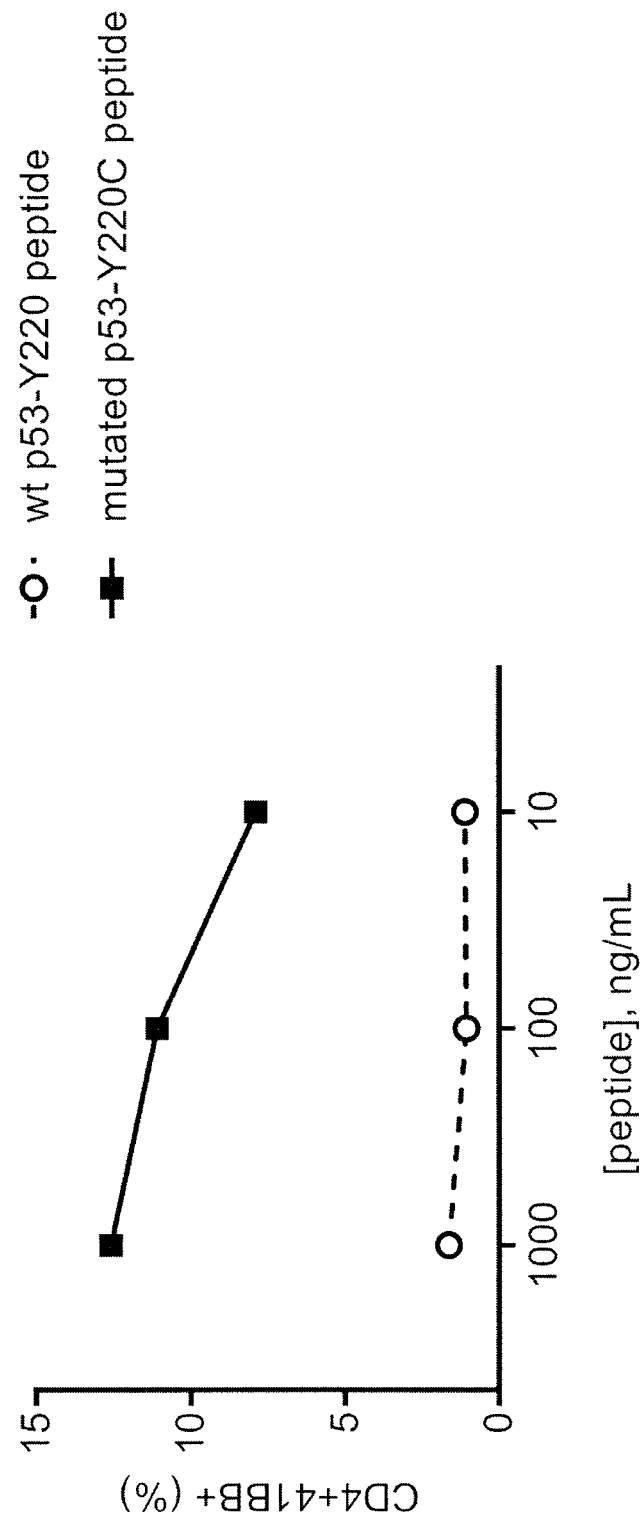

FIG. 43 is a graph showing the percentage of CD4+4-1 BB positive cells detected following co-culture of TIL fragment culture (no. 6) from patient 4259 with autologous APCs pulsed with decreasing concentrations of 25-amino acid peptides corresponding to the WT p53 sequence (open circles) or mutated p53-Y220C (closed squares) for 2 hours at 37° C.

Figure 44:
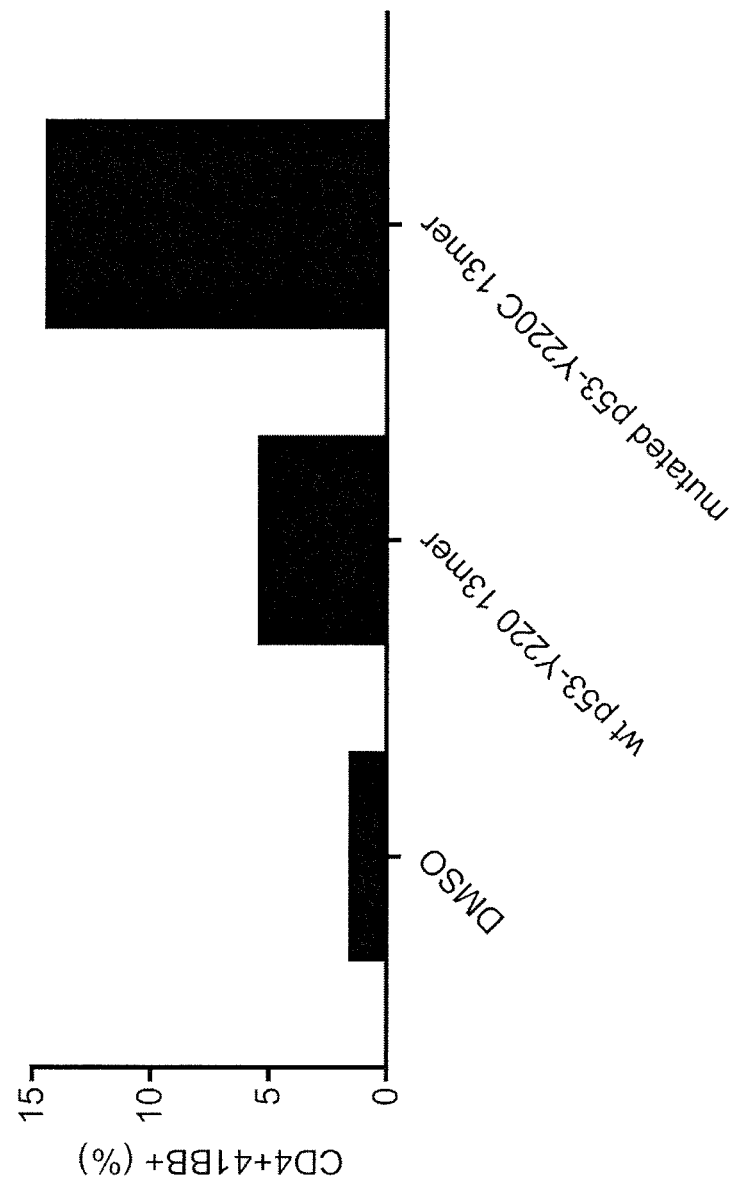

FIG. 44 is a graph showing the percentage of CD4+4-1BB positive cells detected following co-culture of TIL from patient 4259 with autologous APCs pulsed with DMSO, WT p53-Y220 peptide, or mutated p53-Y220C peptide.

Figure 45:
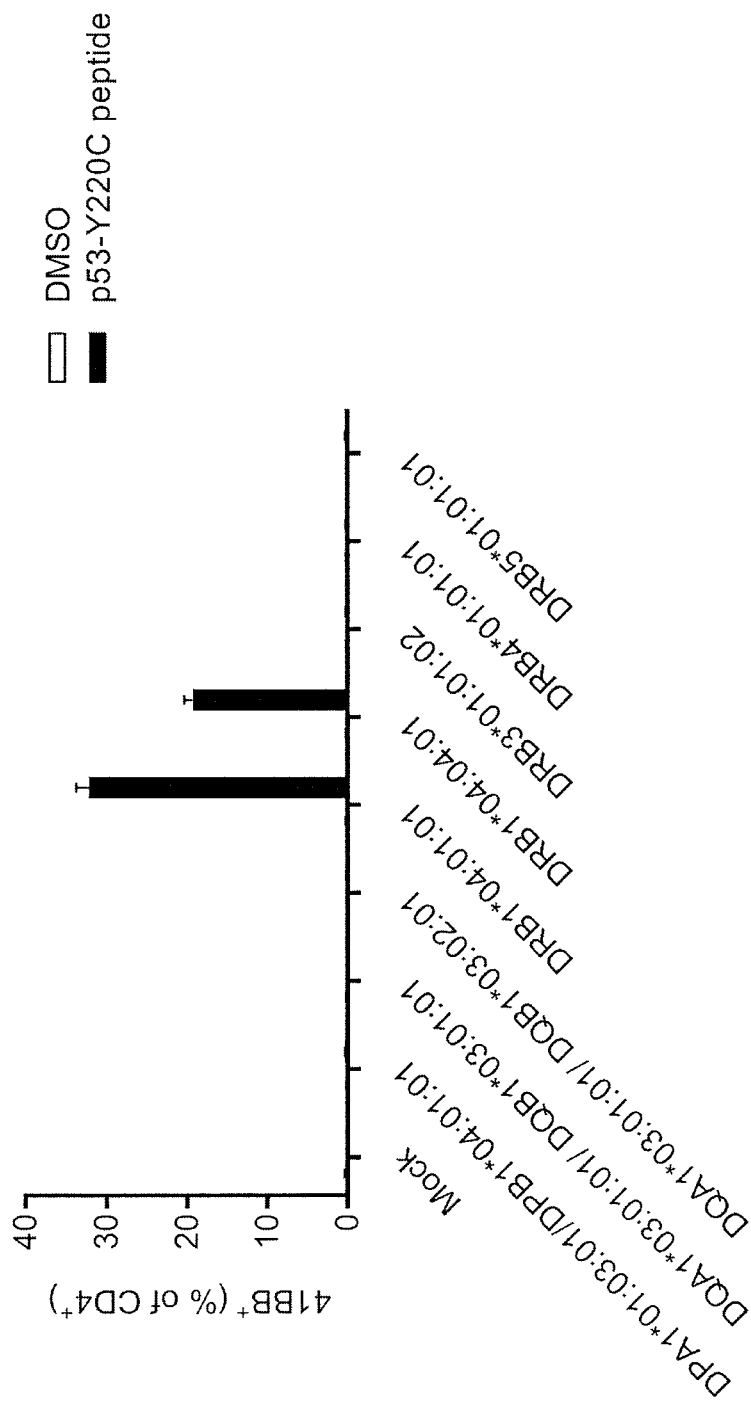

FIG. 45 is a graph showing the percentage of 4-1BB positive cells (% of CD4+) detected following co-culture of TIL fragment culture no. 6 from Patient 4259 with Cos 7 cells co-transfected with the indicated HLA alleles from patient 4259 and pulsed with DMSO (open bars) or the p53-Y220C peptide (closed bars).

Figure 46:
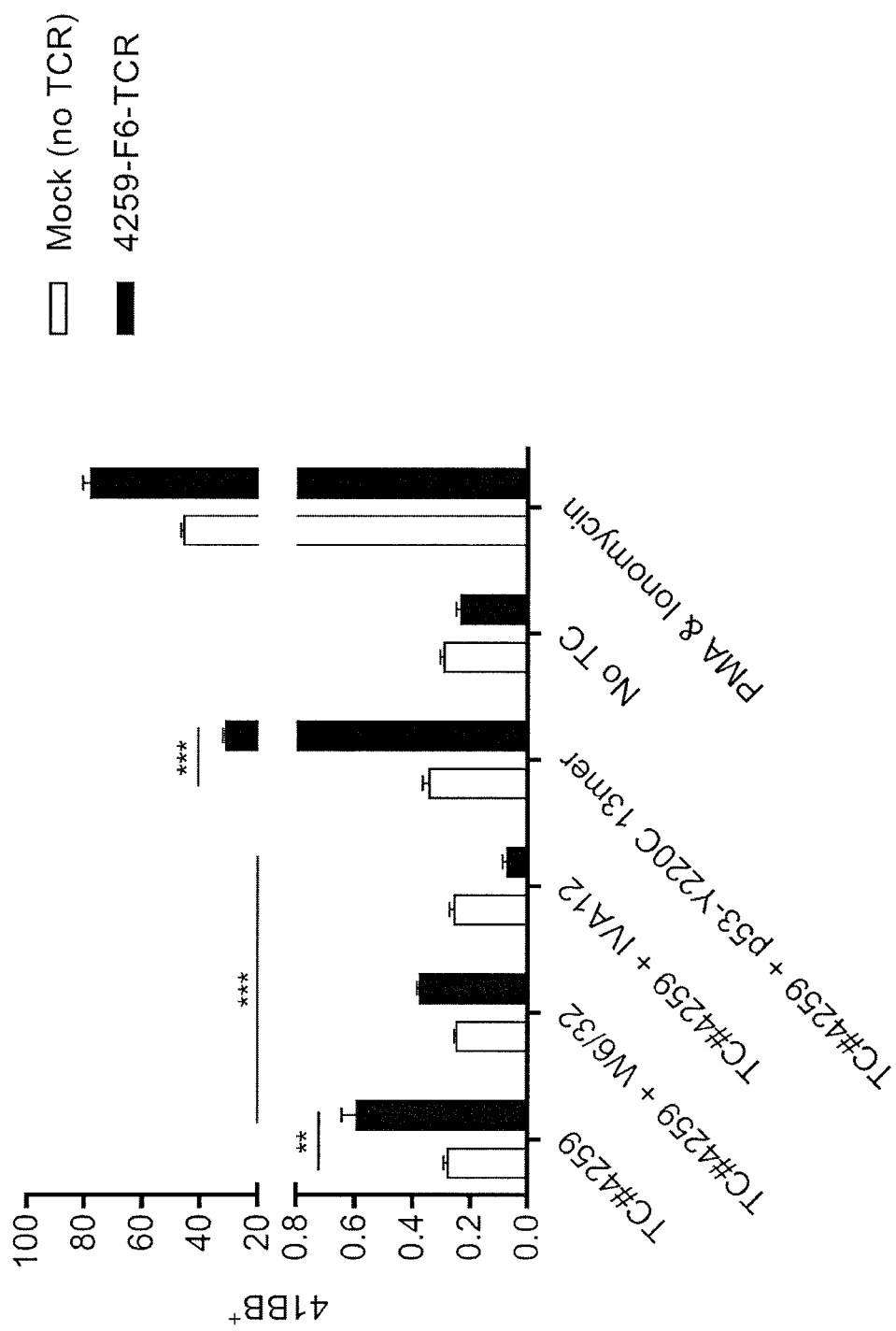

FIG. 46 is a graph showing the percentage of 4-1BB+ cells detected following co-culture of TC #4259 target cells (endogenously expressing p53-Y220C and HLA-DRB1*04: 01:01) with effector T cells ($10^5$) expressing mock (no TCR; open bars) or p53-Y220C-specific TCR (4259-F6-TCR; black bars). The TC #4259 cells were either incubated with nothing, W6/32 pan-HLA Class-1 specific blocking antibody, IVA12 pan-HLA Class-II specific blocking antibody or mutated p53-Y220C peptide. Media alone (no TC) and PMA and Ionomycin were negative and positive controls, respectively. Data are mean±SEM (n=3). Student's two-tailed t-tests were performed between groups as indicated for statistical analyses ($p<0.01$ and *$p<0.001$).

Figure 47:
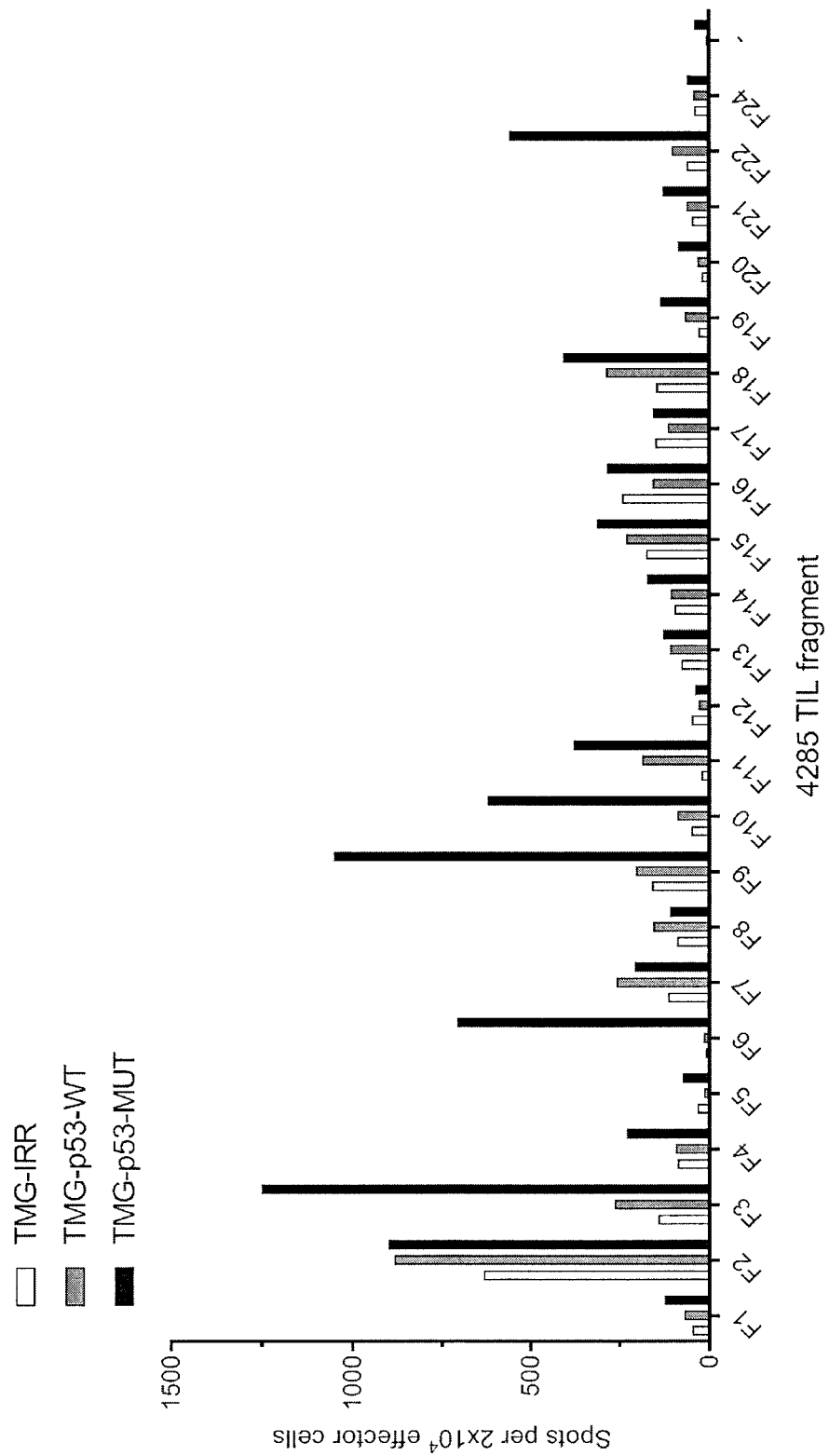

FIG. 47 is a graph showing the number of IFN-γ-positive spots per $2\times10^4$ effector cells measured following co-culture of TIL fragments (F1-F22 and F24, n=23) from patient 4285 with autologous APCs electroporated with TMG composed of irrelevant (IRR; open bars), WT p53 (p53-WT; gray bars) or mutated p53 (p53-MUT; black bars) sequence.

Figure 48:
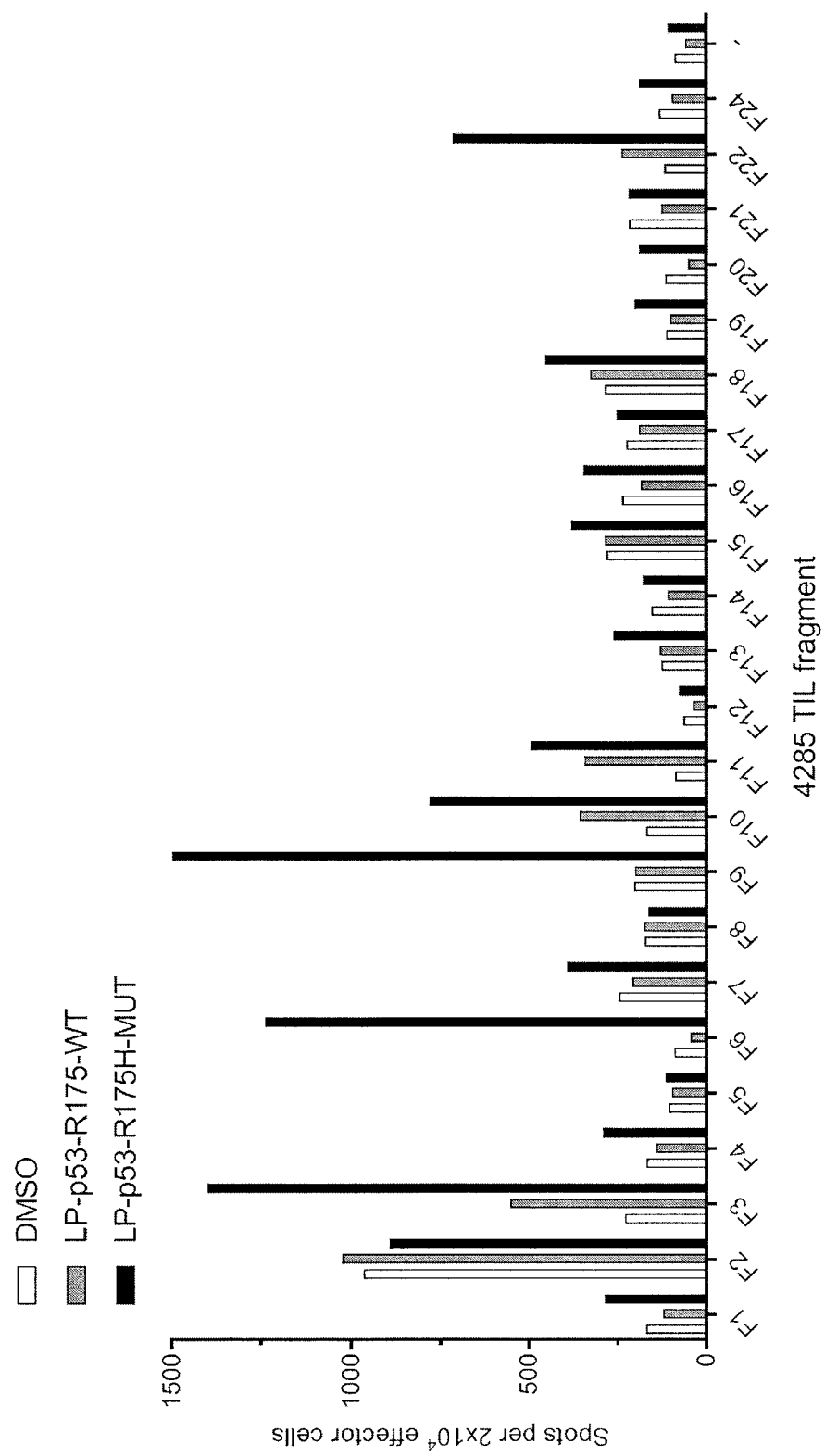

FIG. 48 is a graph showing the number of IFN-γ-positive spots per $2\times10^4$ effector cells measured following co-culture of TIL fragments (F1-F22 and F24, n=23) from patient 4285 with autologous APCs pulsed with peptide vehicle (DMSO; open bars) or purified (>95% by HPLC) 25-amino acid peptides composed of WT p53-R175 sequence (LP-p53-R175-WT; gray bars) or mutated p53-R175H (LP-p53-R175H-MUT; black bars) sequence.

Figure 49:
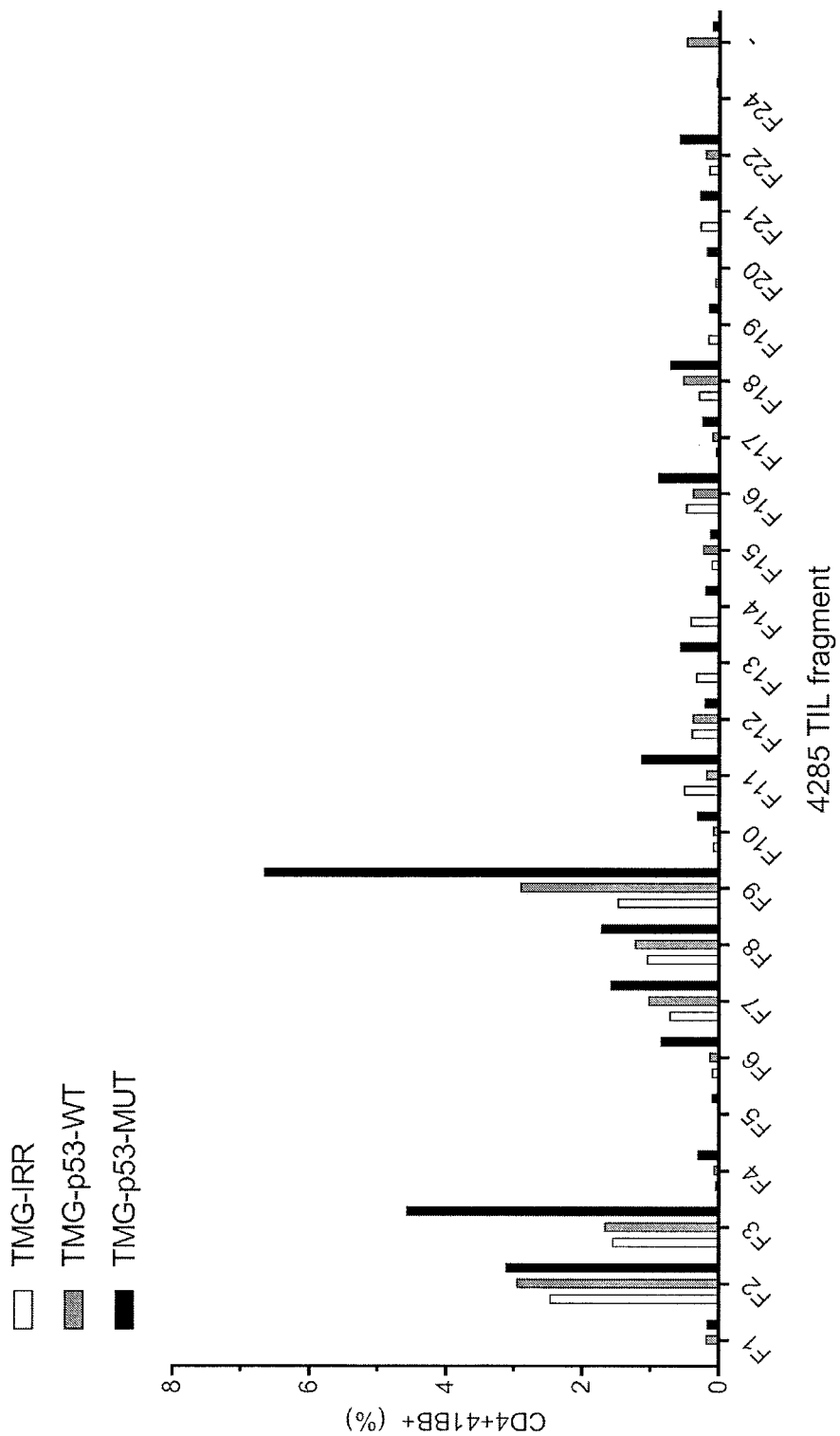

FIG. 49 is a graph showing the percentage of CD4+4-1BB+ cells detected following co-culture of TIL fragments (F1-F22 and F24, n=23) from patient 4285 with autologous APCs electroporated with TMG composed of irrelevant (IRR; open bars), WT type p53 (p53-WT; gray bars) or mutated p53 (p53-MUT; black bars) sequence.

Figure 50:
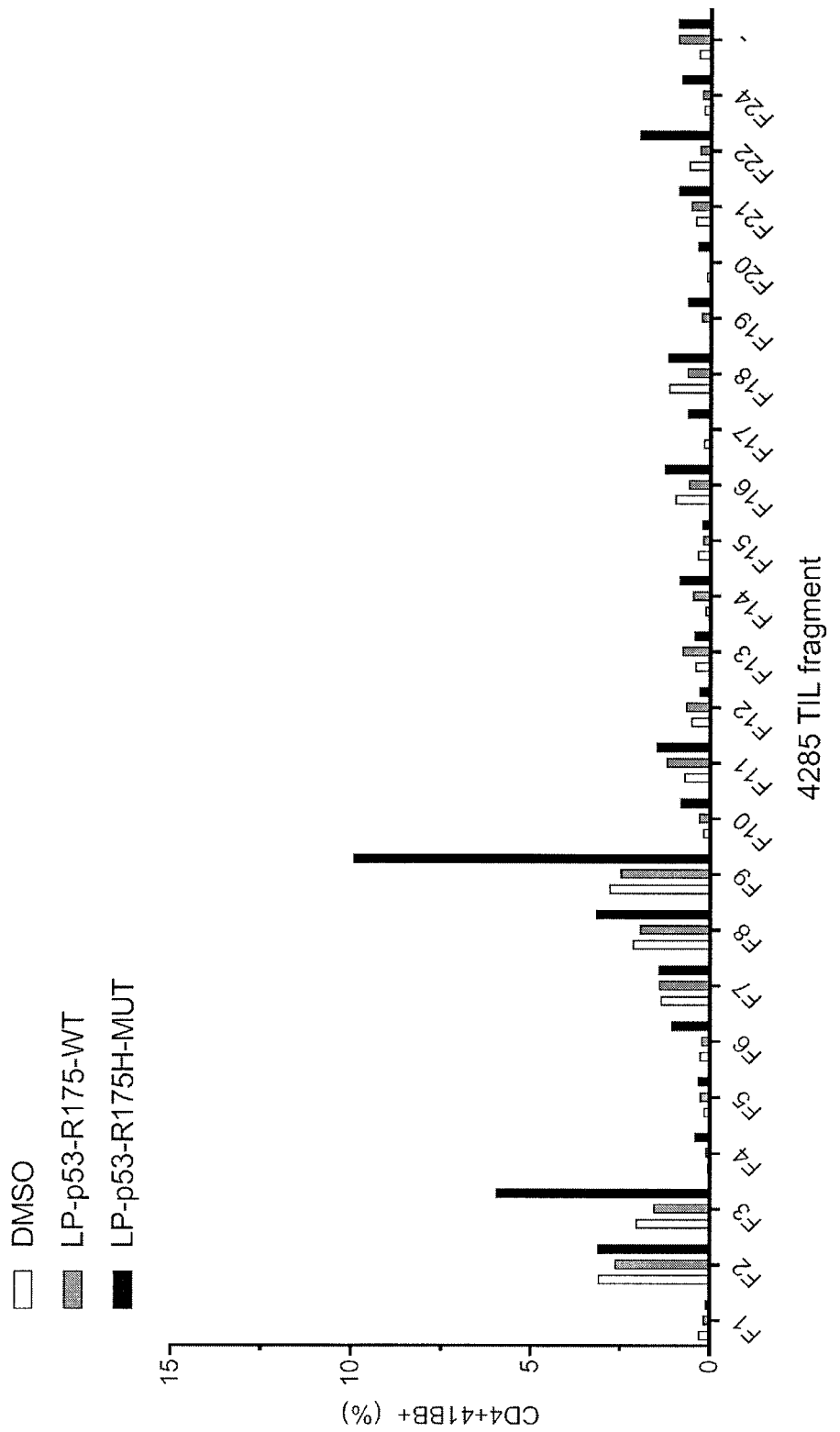

FIG. 50 is a graph showing the percentage of CD4+4-1BB+ cells detected following co-culture of TIL fragments (F1-F22 and F24, n=23) from patient 4285 with autologous APCs pulsed with peptide vehicle (DMSO; open bars) or purified (>95% by HPLC) 25-amino acid peptides composed of WT p53-R175 sequence (LP-p53-R175-WT; gray bars) or mutated p53-R175H (LP-p53-R175H-MUT; black bars) sequences.

Figure 51:
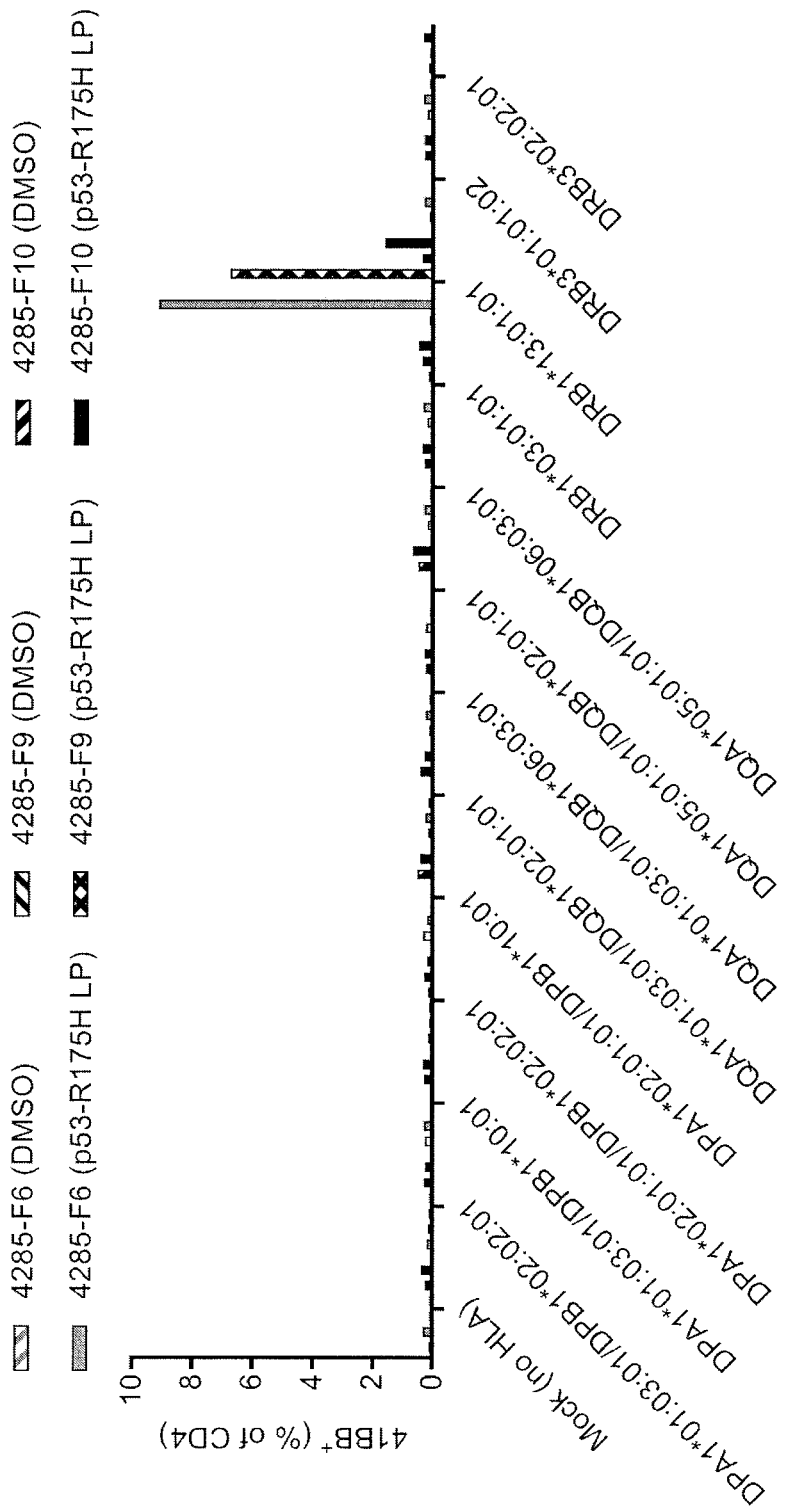

FIG. 51 is a graph showing the percentage of 4-1BB+ cells (% of CD4+) detected following co-culture of TIL fragment cultures 4285-F6, 4285-F9 and 4285-F10 with Cos 7 cells transfected with the indicated HLA alleles and pulsed with DMSO (peptide vehicle; gray and black hatched bars) or mutated p53-R175H peptide (gray, lattice and black bars).

Figure 52:
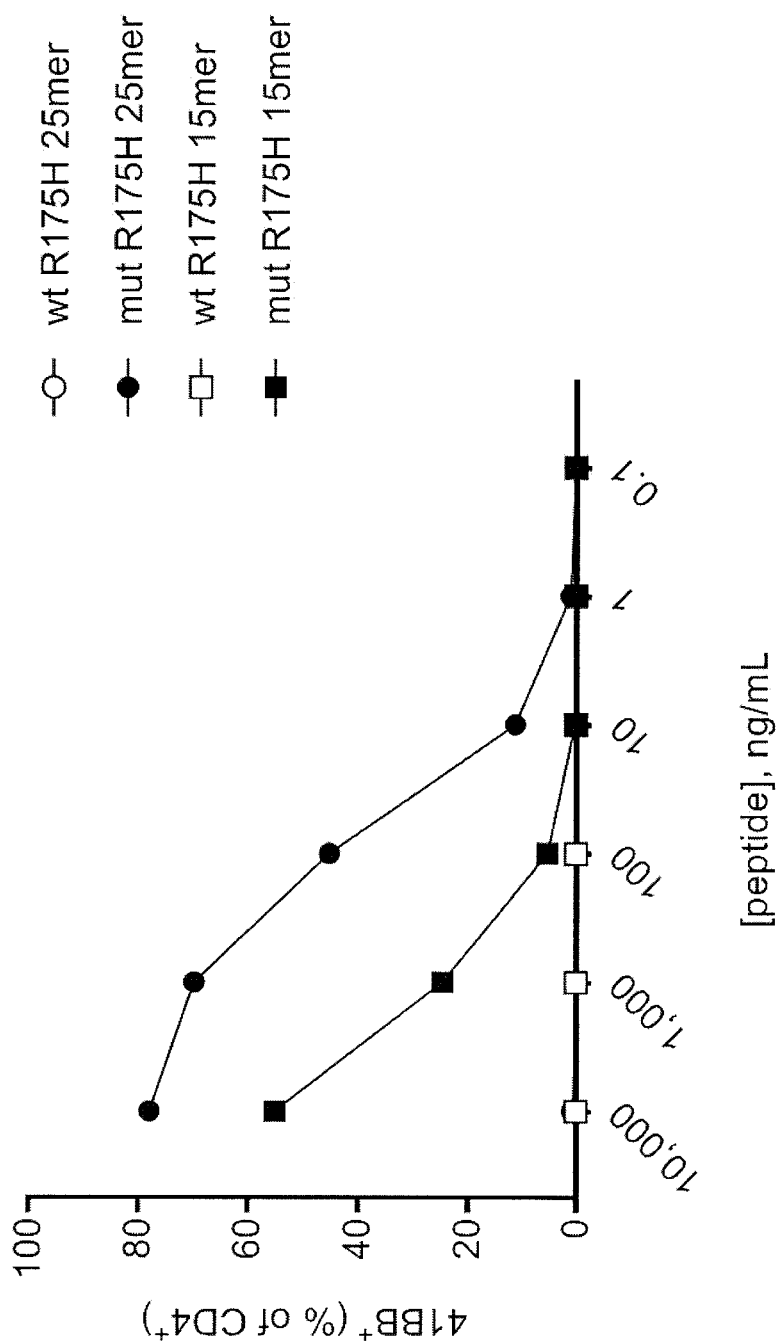

FIG. 52 is a graph showing the percentage of 4-1BB+ cells (% of CD4+) detected following co-culture of T cells transposed with 4285-TCR1 with autologous APCs pulsed with decreasing concentrations of 25- or 15-amino acid peptides corresponding to the WT (open circles and squares) or mutated (closed circles and squares) p53-R175H sequence.

Figure 53:
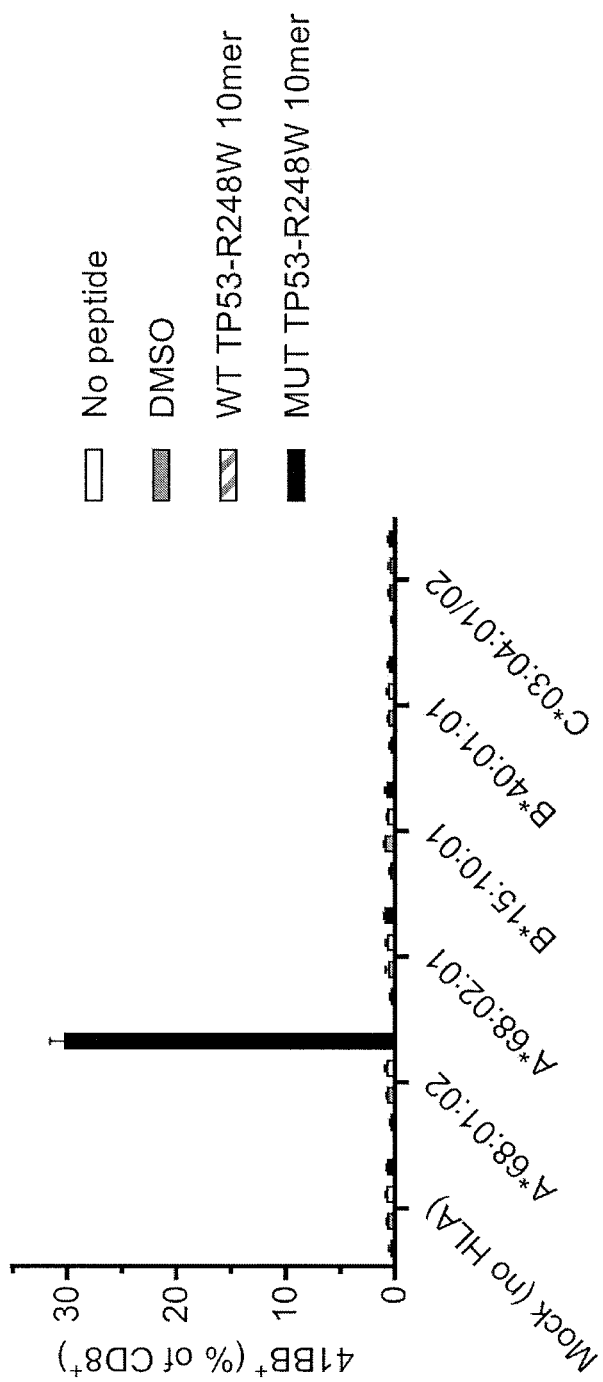

FIG. 53 is a graph showing the percentage of 4-1BB+ cells (% of CD8+) detected following co-culture of TIL from patient 4266 with Cos 7 cells which were co-transfected with individual HLA alleles from patient 4266 and pulsed with no peptide (open bars), DMSO (peptide vehicle; gray bars), wild type p53-R248 peptide (gray hatched bars) or mutated p53-R248W peptide (black bars). Data are mean±SEM (n=3).

Figure 54:
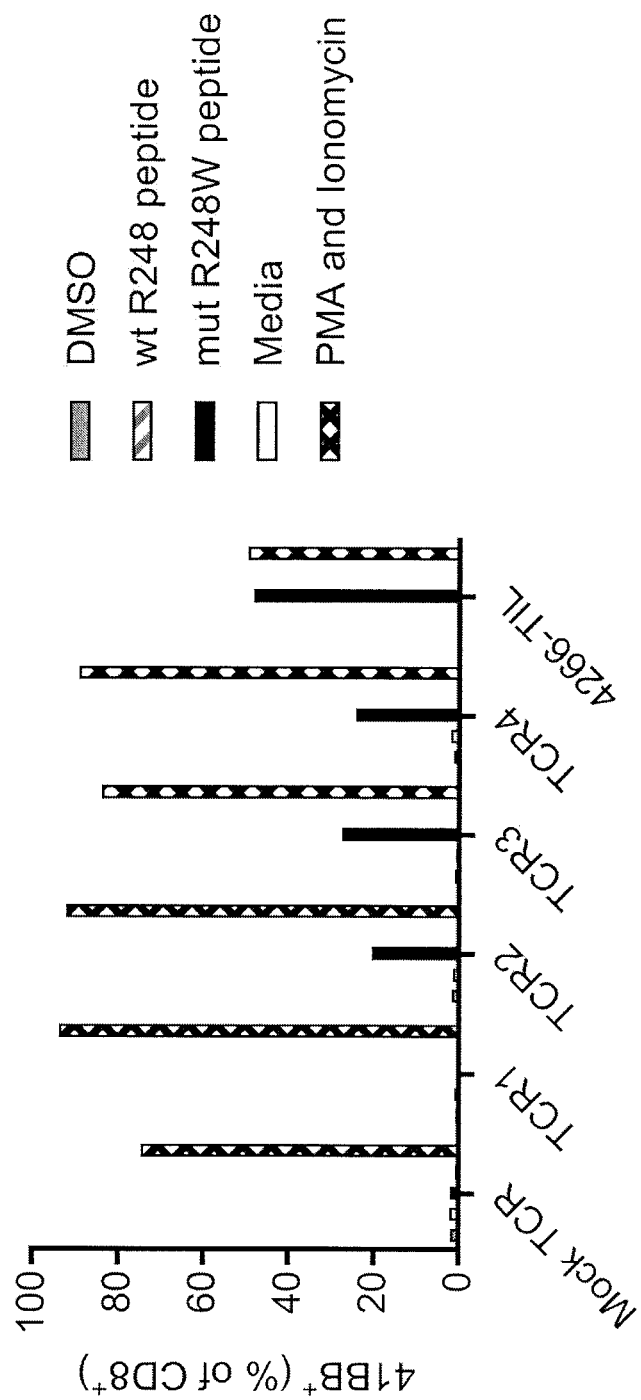

FIG. 54 is a graph showing the percentage of 4-1BB+ cells (% of CD8+) detected following co-culture of T cells expressing mock (no TCR), 4266-TCR1, 4266-TCR2, 4266-TCR3 or 4266-TCR4 with autologous APCs which were pulsed with peptide vehicle (DMSO; gray bars) or purified (>95% by HPLC) 25 amino acid peptides composed of WT p53-R248 sequence (hatched gray bars) or mutated p53-R248W (black bars) sequences. Media alone (open bars) and PMA and Ionomycin (lattice bars) were negative and positive controls, respectively.

Figure 55:
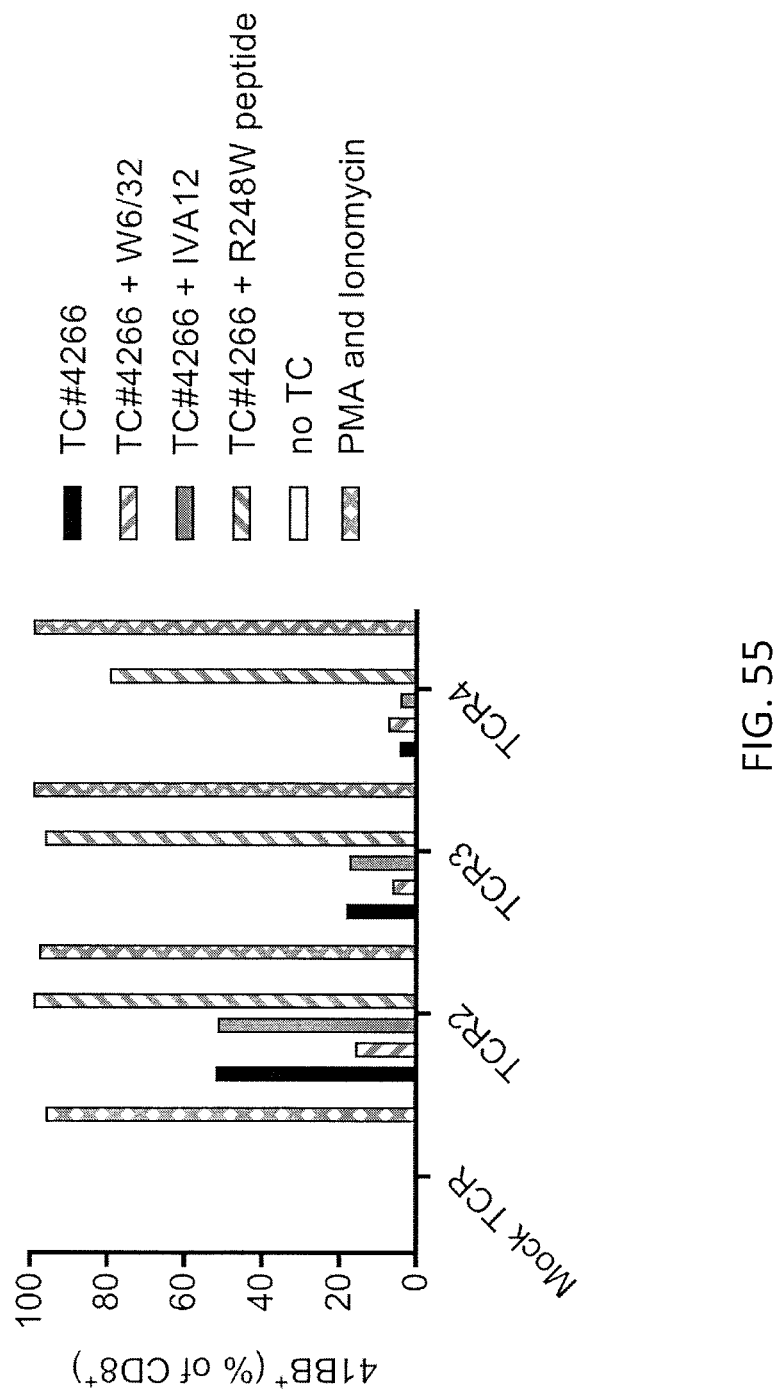

FIG. 55 is a graph showing the percentage of 4-1BB+ cells (% of CD8+) detected following co-culture of T cells expressing mock (no TCR) or p53-R248W-specific TCRs (4266-TCR2, 4266-TCR3 or 4266-TCR4) with tumor cell (TC) line established from xenografted tumor fragment resected from Patient 4266 then serially passaged through immunocompromised mice (TC #4266). The TC #4266 cells were either incubated with nothing (black bars), W6/32 pan-HLA Class-1 specific blocking antibody (right gray hatched bars), IVA12 pan-HLA Class-II specific blocking antibody (gray bars) or mutated p53-R248W peptide (left gray hatched bars). Media alone (no TC; open bars) and PMA and Ionomycin (gray lattice bars) were negative and positive controls, respectively.

Figure 56:
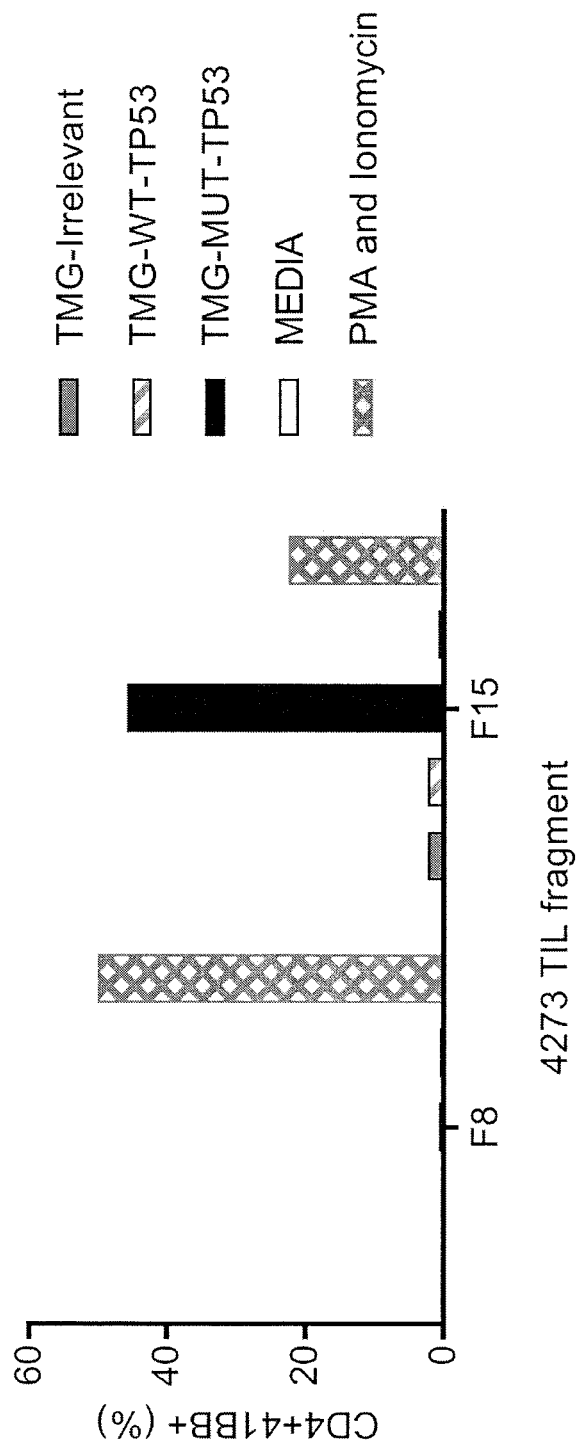

FIG. 56 is a graph showing the percentage of CD4+4-1BB+ cells detected following co-culture of TIL from patient 4273 with autologous APCs which were transfected with TMG encoding irrelevant mutations (gray bars), wild type p53 sequences (gray hatched bars) or mutated p53 sequences including p53-R248W (black bars). Media alone (open bars) and PMA and Ionomycin (lattice bars) were negative and positive controls, respectively.

Figure 57:
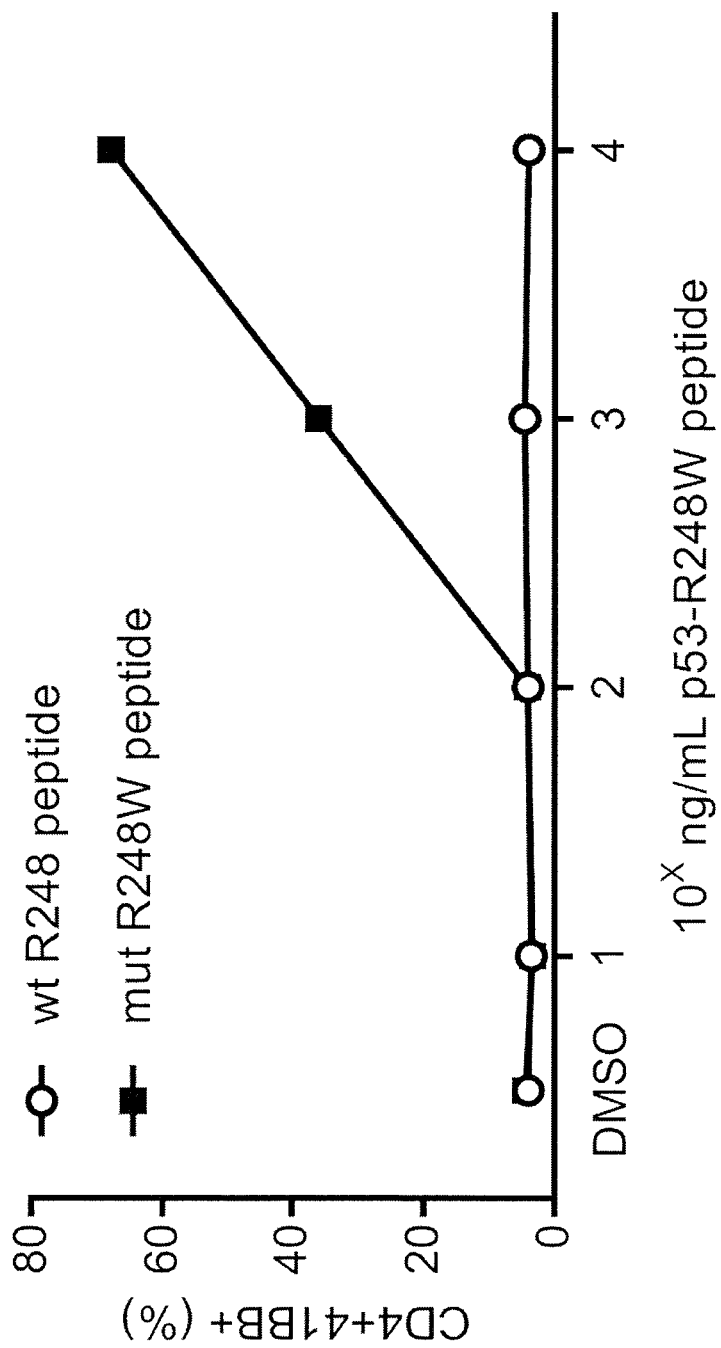

FIG. 57 is a graph showing the percentage of CD4+4-1 BB+ cells detected following co-culture of TIL from patient 4273 with autologous APCs which were pulsed with 25 amino acid peptides corresponding to the wild type (open circles) or mutated (closed squares) from the p53-R248W neoepitope. DMSO was peptide vehicle.

Figure 58:
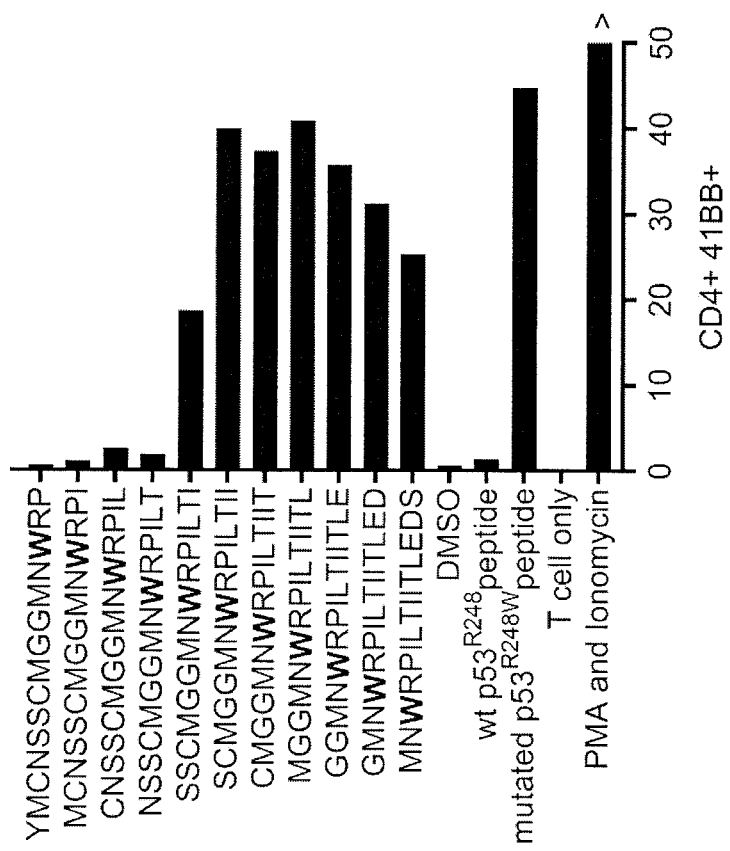

FIG. 58 is a graph showing the percentage of CD4+4-1BB+ cells detected following co-culture of TIL from patient 4273 with autologous APCs pulsed with 15 amino acid peptides from the p53-R248W neoepitope (amino acid substitution in bold) overlapping 14 amino acids. DMSO was peptide vehicle, media alone (T cells only) and PMA and ionomycin were controls. The 25 amino acid peptides (wt p53-R248 and mutated p53-R248W) were additional controls for the 15 amino acid peptides. The peptides are:

```
                                    (SEQ ID NO: 592)
YMCNSSCMGGMNWRP;

(SEQ ID NO: 593)
MCNSSCMGGMNWRPI;

(SEQ ID NO: 594)
CNSSCMGGMNWRPIL;

(SEQ ID NO: 595)
NSSCMGGMNWRPILT;
```

-continued

SSCMGGMNWRPILTI; (SEQ ID NO: 596)

SCMGGMNWRPILTII; (SEQ ID NO: 597)

CMGGMNWRPILTIIT; (SEQ ID NO: 598)

MGGMNWRPILTIITL; (SEQ ID NO: 599)

GGMNWRPILTIITLE; (SEQ ID NO: 600)

GMNWRPILTIITLED; and (SEQ ID NO: 601)

MNWRPILTIITLEDS. (SEQ ID NO: 602)

Figure 59:
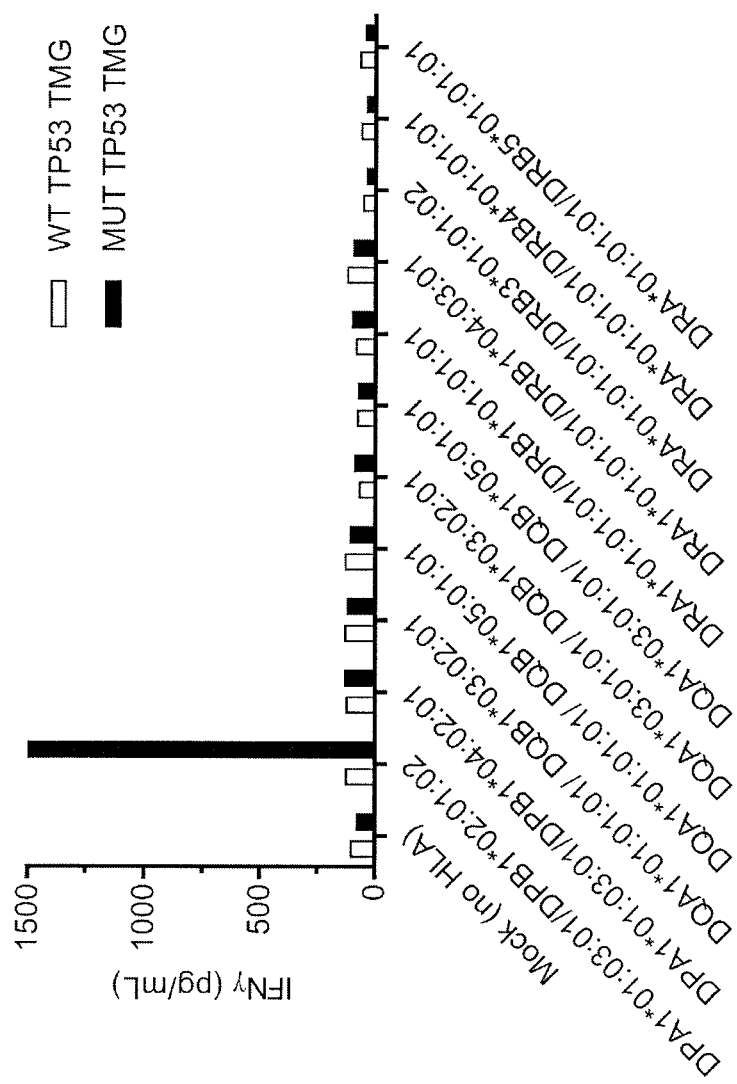

FIG. 59 is a graph showing the concentration of IFN-γ (pg/mL) secreted following co-culture of TIL from Patient 4273 with Cos 7 cells co-transfected with individual HLA alleles from patient 4273 and either WT (open bars) or mutated (black bars) TP53 TMG with or without the p53-R248W neoantigen, respectively.

Figure 60:
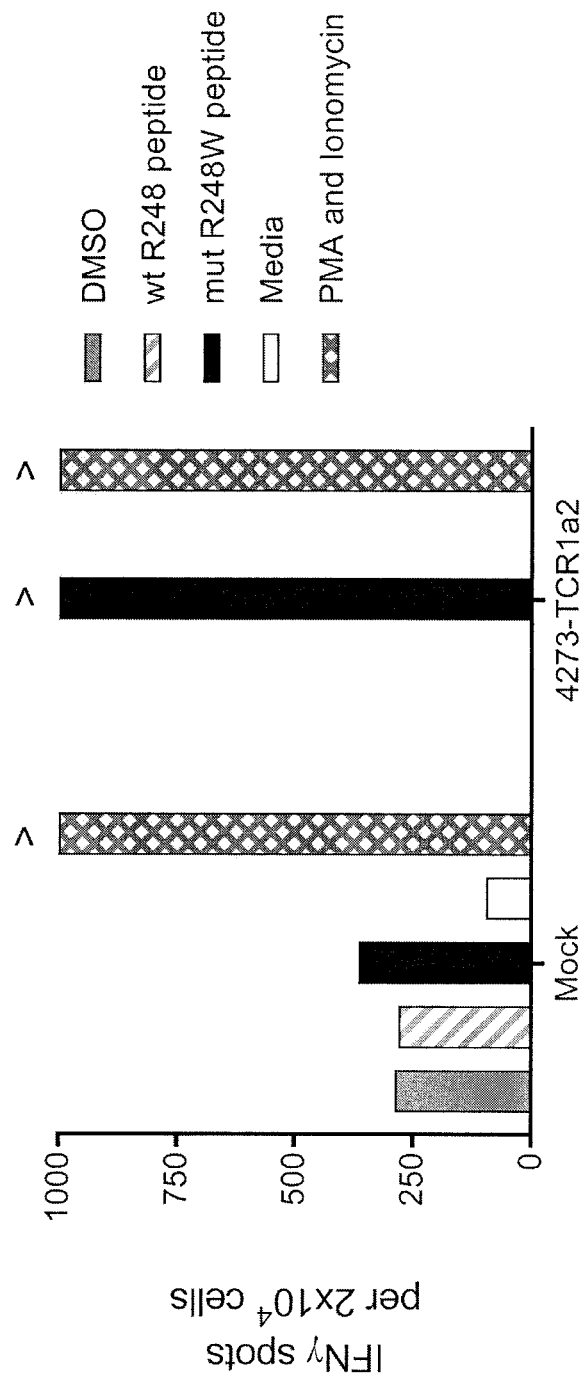

FIG. 60 is a graph showing the number of IFN-γ spots per 2×10⁴ cells measured following co-culture of T cells expressing mock (no TCR) or 4273-TCR1a2 with autologous APCs which were pulsed with peptide vehicle (DMSO; gray bars) or purified (>95% by HPLC) 25 amino acid peptides composed of WT p53-R248 sequence (hatched gray bars) or mutated p53-R248W (black bars) sequences. Media alone (open bars) and PMA and Ionomycin (lattice bars) were negative and positive controls, respectively.

DETAILED DESCRIPTION OF THE INVENTION

Tumor Protein P53 (also referred to as "TP53" or "p53") acts as a tumor suppressor by, for example, regulating cell division. The p53 protein is located in the nucleus of the cell, where it binds directly to DNA. When DNA becomes damaged, the p53 protein is involved in determining whether the DNA will be repaired or the damaged cell will undergo apoptosis. If the DNA can be repaired, p53 activates other genes to fix the damage. If the DNA cannot be repaired, the p53 protein prevents the cell from dividing and signals it to undergo apoptosis. By stopping cells with mutated or damaged DNA from dividing, p53 helps prevent the development of tumors. Wild-type (WT) (normal) full-length p53 comprises the amino acid sequence of SEQ ID NO: 1.

Mutations in the p53 protein may reduce or eliminate the p53 protein's tumor suppressor function. Alternatively or additionally, a p53 mutation may be a gain-of-function mutation by interfering with WT p53 in a dominant negative fashion. Mutated p53 protein may be expressed in any of a variety of human cancers such as, for example, cholangiocarcinoma, melanoma, colon cancer, rectal cancer, ovarian cancer, endometrial cancer, non-small cell lung cancer (NSCLC), glioblastoma, uterine cervical cancer, head and neck cancer, breast cancer, pancreatic cancer, or bladder cancer.

An embodiment of the invention provides an isolated or purified T cell receptor (TCR) having antigenic specificity for mutated human p53 (hereinafter, "mutated p53"). Hereinafter, references to a "TCR" also refer to functional portions and functional variants of the TCR, unless specified otherwise. Mutations of p53 are defined herein by reference to the amino acid sequence of full-length, WT p53 (SEQ ID NO: 1). Thus, mutations of p53 are described herein by reference to the amino acid residue present at a particular position, followed by the position number, followed by the amino acid with which that residue has been replaced in the particular mutation under discussion. For example, when the positions are as defined by SEQ ID NO: 1, the term "R175" refers to the arginine present at position 175 of SEQ ID NO: 1, "R175H" indicates that the arginine present at position 175 of SEQ ID NO: 1 is replaced by histidine, while "G245S" indicates that the glycine present at position 245 of SEQ ID NO: 1 has been replaced with serine. P53 has nine known splice variants. The p53 mutations described herein are conserved over all nine p53 splice variants. An alignment of the nine p53 splice variants is shown in FIG. 35. Accordingly, T cells isolated by the inventive methods may have antigenic specificity for any mutated p53 amino acid sequence described herein encoded by any of the nine p53 splice variants. When the positions are as defined by SEQ ID NO: 1, then the actual positions of the amino acid sequence of a particular splice variant of p53 are defined relative to the corresponding positions of SEQ ID NO: 1, and the positions as defined by SEQ ID NO: 1 may be different than the actual positions in a particular splice variant. Thus, for example, mutations refer to a replacement of an amino acid residue in the amino acid sequence of a particular splice variant of p53 corresponding to the indicated position of the 393-amino acid sequence of SEQ ID NO: 1 with the understanding that the actual positions in the splice variant may be different.

In an embodiment of the invention, the TCR has antigenic specificity for human p53 with a mutation at position 175, 220, 245, 248, 249, 273, or 282 of SEQ ID NO: 1. The TCR may have antigenic specificity for human p53 with a mutation at position 175, 220, 245, or 248 of SEQ ID NO: 1. The p53 mutation may be any missense mutation. Accordingly, the mutation at position 175, 220, 245, 248, 249, 273, or 282 of SEQ ID NO: 1 may be a substitution of the native (WT) amino acid residue present at position 175, 220, 245, 248, 249, 273, or 282 of SEQ ID NO: 1 with any amino acid residue other than the native (WT) amino acid residue present at the particular position under discussion. In an embodiment of the invention, the TCR has antigenic specificity for human p53 with one of the following human p53 mutations: R175H, Y220C, G245D, G245S, R248L, R248Q, R248W, R249S, R273H, R273C, R273L, or R282W. The TCR may have antigenic specificity for human p53 with one of the following human p53 mutations: R175H, Y220C, G245S, R248Q, or R248W. For example, the inventive TCR may have antigenic specificity for a mutated p53 amino acid sequence selected from the group consisting of SEQ ID NOs: 2-13.

In an embodiment of the invention, the inventive TCRs may be able to recognize mutated p53 in an HLA (human leukocyte antigen)-molecule-dependent manner. "HLA-molecule-dependent manner," as used herein, means that the TCR elicits an immune response upon binding to mutated p53 within the context of an HLA molecule, which HLA molecule is expressed by the patient from which the TCR was isolated. The inventive TCRs may be able to recognize mutated p53 that is presented by the applicable HLA molecule and may bind to the HLA molecule in addition to mutated p53.

The TCRs of the invention provide many advantages, including when expressed by cells used for adoptive cell transfer. Mutated p53 is expressed by cancer cells and is not expressed by normal, noncancerous cells. Without being bound to a particular theory or mechanism, it is believed that the inventive TCRs advantageously target the destruction of cancer cells while minimizing or eliminating the destruction of normal, non-cancerous cells, thereby reducing, for example, by minimizing or eliminating, toxicity. Moreover, the inventive TCRs may, advantageously, successfully treat or prevent mutated p53-positive cancers that do not respond to other types of treatment such as, for example, chemotherapy, surgery, or radiation. Additionally, the inventive TCRs may provide highly avid recognition of mutated p53, which may provide the ability to recognize unmanipulated tumor cells (e.g., tumor cells that have not been treated with interferon (IFN)-γ, transfected with a vector encoding one or both of mutated p53 and the applicable HLA molecule, pulsed with a p53 peptide with the p53 mutation, or a combination thereof). Roughly half of all tumors harbor a mutation in p53, about half of which will be a missense mutation and about 30% of the missense mutations occur at the following "hotspot" residues: R175H, Y220C, G245D, G245S, R248L, R248Q, R248W, R249S, R273C, R273L, R273H and R282W. Moreover, the same "hotspot" mutations in p53 (e.g., R175H, Y220C, G245D, G245S, R248L, R248Q, R248W, R249S, R273C, R273L, or R282W) occur frequently (cumulatively about 30% of the p53 missense mutations) in tumors of unrelated people. Accordingly, the inventive TCRs may increase the number of patients who may be eligible for treatment with immunotherapy.

The phrase "antigenic specificity," as used herein, means that the TCR can specifically bind to and immunologically recognize mutated p53 with high avidity. For example, a TCR may be considered to have "antigenic specificity" for mutated p53 if about $1 \times 10^4$ to about $1 \times 10^5$ T cells expressing the TCR secrete at least about 200 pg/mL or more (e.g., 200 pg/mL or more, 300 pg/mL or more, 400 pg/mL or more, 500 pg/mL or more, 600 pg/mL or more, 700 pg/mL or more, 1000 pg/mL or more, 5,000 pg/mL or more, 7,000 pg/mL or more, 10,000 pg/mL or more, 20,000 pg/mL or more, or a range defined by any two of the foregoing values) of IFN-γ upon co-culture with (a) antigen-negative, applicable HLA molecule positive target cells pulsed with a low concentration of mutated p53 peptide (e.g., about 0.05 ng/mL to about 5 ng/mL, 0.05 ng/mL, 0.1 ng/mL, 0.5 ng/mL, 1 ng/mL, 5 ng/mL, or a range defined by any two of the foregoing values) or (b) antigen-negative, applicable HLA molecule positive target cells into which a nucleotide sequence encoding mutated p53 has been introduced such that the target cell expresses mutated p53. Cells expressing the inventive TCRs may also secrete IFN-γ upon co-culture with antigen-negative, applicable HLA molecule positive target cells pulsed with higher concentrations of mutated p53 peptide.

Alternatively or additionally, a TCR may be considered to have "antigenic specificity" for mutated p53 if T cells expressing the TCR secrete at least twice as much IFN-γ upon co-culture with (a) antigen-negative, applicable HLA molecule positive target cells pulsed with a low concentration of mutated p53 peptide or (b) antigen-negative, applicable HLA molecule positive target cells into which a nucleotide sequence encoding mutated p53 has been introduced such that the target cell expresses mutated p53 as compared to the amount of IFN-γ expressed by a negative control. The negative control may be, for example, (i) T cells expressing the TCR, co-cultured with (a) antigen-negative, applicable HLA molecule positive target cells pulsed with the same concentration of an irrelevant peptide (e.g., some other peptide with a different sequence from the mutated p53 peptide) or (b) antigen-negative, applicable HLA molecule positive target cells into which a nucleotide sequence encoding an irrelevant peptide has been introduced such that the target cell expresses the irrelevant peptide, or (ii) untransduced T cells (e.g., derived from PBMC, which do not express the TCR) co-cultured with (a) antigen-negative, applicable HLA molecule positive target cells pulsed with the same concentration of mutated p53 peptide or (b) antigen-negative, applicable HLA molecule positive target cells into which a nucleotide sequence encoding mutated p53 has been introduced such that the target cell expresses mutated p53. IFN-γ secretion may be measured by methods known in the art such as, for example, enzyme-linked immunosorbent assay (ELISA).

Alternatively or additionally, a TCR may be considered to have "antigenic specificity" for mutated p53 if at least twice as many of the numbers of T cells expressing the TCR secrete IFN-γ upon co-culture with (a) antigen-negative, applicable HLA molecule positive target cells pulsed with a low concentration of mutated p53 peptide or (b) antigen-negative, applicable HLA molecule positive target cells into which a nucleotide sequence encoding mutated p53 has been introduced such that the target cell expresses mutated p53 as compared to the numbers of negative control T cells that secrete IFN-γ. The concentration of peptide and the negative control may be as described herein with respect to other aspects of the invention. The numbers of cells secreting IFN-γ may be measured by methods known in the art such as, for example, enzyme-linked immunospot (ELISOT) assay.

Alternatively or additionally, a TCR may be considered to have "antigenic specificity" for mutated p53 if at least twice as many spots are detected by ELISPOT for the T cells expressing the TCR upon co-culture with (a) antigen-negative, applicable HLA molecule positive target cells pulsed with a low concentration of mutated p53 peptide or (b) antigen-negative, applicable HLA molecule positive target cells into which a nucleotide sequence encoding mutated p53 has been introduced such that the target cell expresses mutated p53 as compared to the number of spots detected by ELISPOT for negative control T cells co-cultured with the same target cells. The concentration of peptide and the negative control may be as described herein with respect to other aspects of the invention.

Alternatively or additionally, a TCR may be considered to have "antigenic specificity" for mutated p53 if greater than about 50 spots are detected by ELISPOT for the T cells expressing the TCR upon co-culture with (a) antigen-negative, applicable HLA molecule positive target cells pulsed with a low concentration of mutated p53 peptide or (b) antigen-negative, applicable HLA molecule positive target cells into which a nucleotide sequence encoding mutated p53 has been introduced such that the target cell expresses mutated p53. The concentration of peptide may be as described herein with respect to other aspects of the invention.

Alternatively or additionally, a TCR may be considered to have "antigenic specificity" for mutated p53 if T cells expressing the TCR upregulate expression of one or both of 4-1BB and OX40 as measured by, for example, flow cytometry after stimulation with target cells expressing mutated p53.

The invention provides a TCR comprising two polypeptides (i.e., polypeptide chains), such as an alpha (α) chain of a TCR, a beta (β) chain of a TCR, a gamma (γ) chain of a TCR, a delta (δ) chain of a TCR, or a combination thereof.

The polypeptides of the inventive TCR can comprise any amino acid sequence, provided that the TCR has antigenic specificity for mutated p53.

In an embodiment of the invention, the TCR comprises two polypeptide chains, each of which comprises a variable region comprising a complementarity determining region (CDR)1, a CDR2, and a CDR3 of a TCR. In an embodiment of the invention, the TCR comprises a first polypeptide chain comprising an α chain CDR1 (CDR1α), an α chain CDR2 (CDR2α), and an α chain CDR3 (CDR3α), and a second polypeptide chain comprising a β chain CDR1 (CDR1β), a β chain CDR2 (CDR2β), and a β chain CDR3 (CDR3β). In an embodiment of the invention, the TCR comprises the amino acid sequences of: (1) all of SEQ ID NOs: 27-32; (2) all of SEQ ID NOs: 37-42; (3) all of SEQ ID NOs: 47-52; (4) all of SEQ ID NOs: 57-62; (5) all of SEQ ID NOs: 67-72; (6) all of SEQ ID NOs: 77-82; (7) all of SEQ ID NOs: 87-92; (8) all of SEQ ID NOs: 97-102; (9) all of SEQ ID NOs: 107-112; (10) all of SEQ ID NOs: 117-122; (11) all of SEQ ID NOs: 127-132; (12) all of SEQ ID NOs: 137-142; (13) all of SEQ ID NOs: 147-152; (14) all of SEQ ID NOs: 157-162; (15) all of SEQ ID NOs: 167-172; (16) all of SEQ ID NOs: 177-182; (17) all of SEQ ID NOs: 187-192; (18) all of SEQ ID NOs: 197-202; (19) all of SEQ ID NOs: 207-212; (20) all of SEQ ID NOs: 217-222; (21) all of SEQ ID NOs: 227-232; (22) all of SEQ ID NOs: 237-242; (23) all of SEQ ID NOs: 247-252; (24) all of SEQ ID NOs: 257-262; (25) all of SEQ ID NOs: 267-272; (26) all of SEQ ID NOs: 277-282; (27) all of SEQ ID NOs: 287-292; (28) all of SEQ ID NOs: 297-302; (29) all of SEQ ID NOs: 307-312; (30) all of SEQ ID NOs: 317-322; (31) all of SEQ ID NOs: 327-332; (32) all of SEQ ID NOs: 337-342; (33) all of SEQ ID NOs: 347-352; (34) all of SEQ ID NOs: 357-362; (35) all of SEQ ID NOs: 367-372; (36) all of SEQ ID NOs: 377-382; (37) all of SEQ ID NOs: 387-392; (38) all of SEQ ID NOs: 397-402; (39) all of SEQ ID NOs: 407-412; (40) all of SEQ ID NOs: 417-422; (41) all of SEQ ID NOs: 427-432; (42) all of SEQ ID NOs: 437-442; (43) all of SEQ ID NOs: 447-452; (44) all of SEQ ID NOs: 457-462; (45) all of SEQ ID NOs: 467-472; (46) all of SEQ ID NOs: 477-482; or (47) all of SEQ ID NOs: 487-492. Each one of the foregoing 47 collections of amino acid sequences in this paragraph sets forth the six CDR regions of each of 47 different TCRs having antigenic specificity for mutated human p53. The six amino acid sequences in each collection correspond to the CDR1α, CDR2α, CDR3α, CDR1β, CDR2β, and CDR3β of a TCR, respectively.

In an embodiment of the invention, the TCR comprises an α chain variable region amino acid sequence and a β chain variable region amino acid sequence which together comprise one of the collections of CDRs set forth above. In this regard, the TCR can comprise the amino acid sequences of: (1) both of SEQ ID NOs: 33-34; (2) both of SEQ ID NOs: 43-44; (3) both of SEQ ID NOs: 53-54; (4) both of SEQ ID NOs: 63-64; (5) both of SEQ ID NOs: 73-74; (6) both of SEQ ID NOs: 83-84; (7) both of SEQ ID NOs: 93-94; (8) both of SEQ ID NOs: 103-104; (9) both of SEQ ID NOs: 113-114; (10) both of SEQ ID NOs: 123-124; (11) both of SEQ ID NOs: 133-134; (12) both of SEQ ID NOs: 143-144; (13) both of SEQ ID NOs: 153-154; (14) both of SEQ ID NOs: 163-164; (15) both of SEQ ID NOs: 173-174; (16) both of SEQ ID NOs: 183-184; (17) both of SEQ ID NOs: 193-194; (18) both of SEQ ID NOs: 203-204; (19) both of SEQ ID NOs: 213-214; (20) both of SEQ ID NOs: 223-224; (21) both of SEQ ID NOs: 233-234; (22) both of SEQ ID NOs: 243-244; (23) both of SEQ ID NOs: 253-254; (24) both of SEQ ID NOs: 263-264; (25) both of SEQ ID NOs: 273-274; (26) both of SEQ ID NOs: 283-284; (27) both of SEQ ID NOs: 293-294; (28) both of SEQ ID NOs: 303-304; (29) both of SEQ ID NOs: 313-314; (30) both of SEQ ID NOs: 323-324; (31) both of SEQ ID NOs: 333-334; (32) both of SEQ ID NOs: 343-344; (33) both of SEQ ID NOs: 353-354; (34) both of SEQ ID NOs: 363-364; (35) both of SEQ ID NOs: 373-374; (36) both of SEQ ID NOs: 383-384; (37) both of SEQ ID NOs: 393-394; (38) both of SEQ ID NOs: 403-404; (39) both of SEQ ID NOs: 413-414; (40) both of SEQ ID NOs: 423-424; (41) both of SEQ ID NOs: 433-434; (42) both of SEQ ID NOs: 443-444; (43) both of SEQ ID NOs: 453-454; (44) both of SEQ ID NOs: 463-464; (45) both of SEQ ID NOs: 473-474; (46) both of SEQ ID NOs: 483-484; or (47) both of SEQ ID NOs: 493-494. Each one of the foregoing 47 collections of amino acid sequences in this paragraph sets forth the two variable regions of each of 47 different TCRs having antigenic specificity for mutated human p53. The two amino acid sequences in each collection correspond to the variable region of the α chain and the variable region of the β chain of a TCR, respectively.

The inventive TCRs may further comprise a constant region. The constant region may be derived from any suitable species such as, e.g., human or mouse. In an embodiment of the invention, the TCRs further comprise a murine constant region. As used herein, the term "murine" or "human," when referring to a TCR or any component of a TCR described herein (e.g., complementarity determining region (CDR), variable region, constant region, alpha chain, and/or beta chain), means a TCR (or component thereof) which is derived from a mouse or a human, respectively, i.e., a TCR (or component thereof) that originated from or was, at one time, expressed by a mouse T cell or a human T cell, respectively. In an embodiment of the invention, the TCR may comprise a murine α chain constant region and a murine β chain constant region. The murine α chain constant region may be modified or unmodified. A modified murine α chain constant region may be, e.g., cysteine-substituted, LVL-modified, or both cysteine-substituted and LVL-modified, as described, for example, in US 2017/0145070. The murine β chain constant region may be modified or unmodified. A modified murine β chain constant region may be, e.g., cysteine-substituted, as described, for example, in US 2017/0145070. In an embodiment of the invention, the TCR comprises a cysteine-substituted, LVL-modified murine α chain constant region comprising the amino acid sequence of SEQ ID NO: 23 or 24. In an embodiment of the invention, the TCR comprises a cysteine-substituted murine β chain constant region comprising the amino acid sequence of SEQ ID NO: 25.

In an embodiment of the invention, the inventive TCR can comprise an α chain of a TCR and a β chain of a TCR. The α chain of the TCR may comprise a variable region of an α chain and a constant region of an α chain. An α chain of this type can be paired with any 1 chain of a TCR. The β chain may comprise a variable region of a β chain and a constant region of a ρβ chain. In an embodiment of the invention, the TCR comprises the amino acid sequences of: (1) both of SEQ ID NOs: 35-36; (2) both of SEQ ID NOs: 45-46; (3) both of SEQ ID NOs: 55-56; (4) both of SEQ ID NOs: 65-66; (5) both of SEQ ID NOs: 75-76; (6) both of SEQ ID NOs: 85-86; (7) both of SEQ ID NOs: 95-96; (8) both of SEQ ID NOs: 105-106; (9) both of SEQ ID NOs: 115-116; (10) both of SEQ ID NOs: 125-126; (11) both of SEQ ID NOs: 135-136; (12) both of SEQ ID NOs: 145-146; (13) both of SEQ ID NOs: 155-156; (14) both of SEQ ID NOs: 165-166; (15) both of SEQ ID NOs: 175-176; (16) both of SEQ ID NOs: 185-186; (17) both of SEQ ID NOs: 195-196; (18) both of SEQ ID NOs: 205-206; (19) both of SEQ ID NOs: 215-216; (20) both of SEQ ID NOs: 225-226; (21) both of SEQ ID NOs: 235-236; (22) both of SEQ ID NOs: 245-246; (23) both of SEQ ID NOs: 255-256; (24) both of SEQ ID NOs: 265-266; (25) both of SEQ ID NOs: 275-276; (26) both of SEQ ID NOs: 285-286; (27) both of SEQ ID NOs: 295-296; (28) both of SEQ ID NOs: 305-306; (29) both of SEQ ID NOs: 315-316; (30) both of SEQ ID NOs: 325-326; (31) both of SEQ ID NOs: 335-336; (32) both of SEQ ID NOs: 345-346; (33) both of SEQ ID NOs: 355-356; (34) both of SEQ ID NOs: 365-366; (35) both of SEQ ID NOs: 375-376; (36) both of SEQ ID NOs: 385-386; (37) both of SEQ ID NOs: 395-396; (38) both of SEQ ID NOs: 405-406; (39) both of SEQ ID NOs: 415-416; (40) both of SEQ ID NOs: 425-426; (41) both of SEQ ID NOs: 435-436; (42) both of SEQ ID NOs: 445-446; (43) both of SEQ ID NOs: 455-456; (44) both of SEQ ID NOs: 465-466; (45) both of SEQ ID NOs: 475-476; (46) both of SEQ ID NOs: 485-486; or (47) both of SEQ ID NOs: 495-496. Each one of the foregoing 47 collections of amino acid sequences in this paragraph sets forth the α chain and β chain of each of 47 different TCRs having antigenic specificity for mutated human p53. The two amino acid sequences in each collection correspond to the α chain and the β chain of a TCR, respectively.

Included in the scope of the invention are functional variants of the inventive TCRs described herein. The term "functional variant," as used herein, refers to a TCR, polypeptide, or protein having substantial or significant sequence identity or similarity to a parent TCR, polypeptide, or protein, which functional variant retains the biological activity of the TCR, polypeptide, or protein of which it is a variant. Functional variants encompass, for example, those variants of the TCR, polypeptide, or protein described herein (the parent TCR, polypeptide, or protein) that retain the ability to specifically bind to mutated p53 for which the parent TCR has antigenic specificity or to which the parent polypeptide or protein specifically binds, to a similar extent, the same extent, or to a higher extent, as the parent TCR, polypeptide, or protein. In reference to the parent TCR, polypeptide, or protein, the functional variant can, for instance, be at least about 30%, at least about 50%, at least about 75%, at least about 80%, at least about 90%, at least about 95%, at least about 96%, at least about 97%, at least about 98%, at least about 99% or more identical in amino acid sequence to the parent TCR, polypeptide, or protein, respectively.

The functional variant can, for example, comprise the amino acid sequence of the parent TCR, polypeptide, or protein with at least one conservative amino acid substitution. Conservative amino acid substitutions are known in the art, and include amino acid substitutions in which one amino acid having certain physical and/or chemical properties is exchanged for another amino acid that has the same chemical or physical properties. For instance, the conservative amino acid substitution can be an acidic amino acid substituted for another acidic amino acid (e.g., Asp or Glu), an amino acid with a nonpolar side chain substituted for another amino acid with a nonpolar side chain (e.g., Ala, Gly, Val, Ile, Leu, Met, Phe, Pro, Trp, Val, etc.), a basic amino acid substituted for another basic amino acid (Lys, Arg, etc.), an amino acid with a polar side chain substituted for another amino acid with a polar side chain (Asn, Cys, Gln, Ser, Thr, Tyr, etc.), etc.

Alternatively or additionally, the functional variants can comprise the amino acid sequence of the parent TCR, polypeptide, or protein with at least one non-conservative amino acid substitution. In this case, it is preferable for the non-conservative amino acid substitution to not interfere with or inhibit the biological activity of the functional variant. Preferably, the non-conservative amino acid substitution enhances the biological activity of the functional variant, such that the biological activity of the functional variant is increased as compared to the parent TCR, polypeptide, or protein.

The TCR, polypeptide, or protein can consist essentially of the specified amino acid sequence or sequences described herein, such that other components of the TCR, polypeptide, or protein, e.g., other amino acids, do not materially change the biological activity of the TCR, polypeptide, or protein.

Also provided by the invention is a polypeptide comprising a functional portion of any of the TCRs described herein. The term "polypeptide," as used herein, includes oligopeptides and refers to a single chain of amino acids connected by one or more peptide bonds.

With respect to the inventive polypeptides, the functional portion can be any portion comprising contiguous amino acids of the TCR of which it is a part, provided that the functional portion specifically binds to mutated p53. The term "functional portion," when used in reference to a TCR, refers to any part or fragment of the TCR of the invention, which part or fragment retains the biological activity of the TCR of which it is a part (the parent TCR). Functional portions encompass, for example, those parts of a TCR that retain the ability to specifically bind to mutated p53 (e.g., in an applicable HLA molecule-dependent manner), or detect, treat, or prevent cancer, to a similar extent, the same extent, or to a higher extent, as the parent TCR. In reference to the parent TCR, the functional portion can comprise, for instance, about 10%, about 25%, about 30%, about 50%, about 68%, about 80%, about 90%, about 95%, or more, of the parent TCR.

The functional portion can comprise additional amino acids at the amino or carboxy terminus of the portion, or at both termini, which additional amino acids are not found in the amino acid sequence of the parent TCR. Desirably, the additional amino acids do not interfere with the biological function of the functional portion, e.g., specifically binding to mutated p53; and/or having the ability to detect cancer, treat or prevent cancer, etc. More desirably, the additional amino acids enhance the biological activity, as compared to the biological activity of the parent TCR.

The polypeptide can comprise a functional portion of either or both of the α and β chains of the TCRs of the invention, such as a functional portion comprising one of more of CDR1, CDR2, and CDR3 of the variable region(s) of the α chain and/or β chain of a TCR of the invention. In an embodiment of the invention, the polypeptide can comprise a functional portion comprising the amino acid sequences of: (1) all of SEQ ID NOs: 27-32; (2) all of SEQ ID NOs: 37-42; (3) all of SEQ ID NOs: 47-52; (4) all of SEQ ID NOs: 57-62; (5) all of SEQ ID NOs: 67-72; (6) all of SEQ ID NOs: 77-82; (7) all of SEQ ID NOs: 87-92; (8) all of SEQ ID NOs: 97-102; (9) all of SEQ ID NOs: 107-112; (10) all of SEQ ID NOs: 117-122; (11) all of SEQ ID NOs: 127-132; (12) all of SEQ ID NOs: 137-142; (13) all of SEQ ID NOs: 147-152; (14) all of SEQ ID NOs: 157-162; (15) all of SEQ ID NOs: 167-172; (16) all of SEQ ID NOs: 177-182; (17) all of SEQ ID NOs: 187-192; (18) all of SEQ ID NOs: 197-202; (19) all of SEQ ID NOs: 207-212; (20) all of SEQ ID NOs: 217-222; (21) all of SEQ ID NOs: 227-232; (22) all of SEQ ID NOs: 237-242; (23) all of SEQ ID NOs: 247-252; (24) all of SEQ ID NOs: 257-262; (25) all of SEQ ID NOs: 267-272; (26) all of SEQ ID NOs: 277-282; (27) all of SEQ ID NOs: 287-292; (28) all of SEQ ID NOs: 297-302; (29) all of SEQ ID NOs: 307-312; (30) all of SEQ ID NOs: 317-322; (31) all of SEQ ID NOs: 327-332; (32) all of SEQ ID NOs: 337-342; (33) all of SEQ ID NOs: 347-352; (34) all of SEQ ID NOs: 357-362; (35) all of SEQ ID NOs: 367-372; (36) all of SEQ ID NOs: 377-382; (37) all of SEQ ID NOs: 387-392; (38) all of SEQ ID NOs: 397-402; (39) all of SEQ ID NOs: 407-412; (40) all of SEQ ID NOs: 417-422; (41) all of SEQ ID NOs: 427-432; (42) all of SEQ ID NOs: 437-442; (43) all of SEQ ID NOs: 447-452; (44) all of SEQ ID NOs: 457-462; (45) all of SEQ ID NOs: 467-472; (46) all of SEQ ID NOs: 477-482; or (47) all of SEQ ID NOs: 487-492.

In an embodiment of the invention, the inventive polypeptide can comprise, for instance, the variable region of the inventive TCR comprising a combination of the CDR regions set forth above. In this regard, the polypeptide can comprise the amino acid sequences of: (1) both of SEQ ID NOs: 33-34; (2) both of SEQ ID NOs: 43-44; (3) both of SEQ ID NOs: 53-54; (4) both of SEQ ID NOs: 63-64; (5) both of SEQ ID NOs: 73-74; (6) both of SEQ ID NOs: 83-84; (7) both of SEQ ID NOs: 93-94; (8) both of SEQ ID NOs: 103-104; (9) both of SEQ ID NOs: 113-114; (10) both of SEQ ID NOs: 123-124; (11) both of SEQ ID NOs: 133-134; (12) both of SEQ ID NOs: 143-144; (13) both of SEQ ID NOs: 153-154; (14) both of SEQ ID NOs: 163-164; (15) both of SEQ ID NOs: 173-174; (16) both of SEQ ID NOs: 183-184; (17) both of SEQ ID NOs: 193-194; (18) both of SEQ ID NOs: 203-204; (19) both of SEQ ID NOs: 213-214; (20) both of SEQ ID NOs: 223-224; (21) both of SEQ ID NOs: 233-234; (22) both of SEQ ID NOs: 243-244; (23) both of SEQ ID NOs: 253-254; (24) both of SEQ ID NOs: 263-264; (25) both of SEQ ID NOs: 273-274; (26) both of SEQ ID NOs: 283-284; (27) both of SEQ ID NOs: 293-294; (28) both of SEQ ID NOs: 303-304; (29) both of SEQ ID NOs: 313-314; (30) both of SEQ ID NOs: 323-324; (31) both of SEQ ID NOs: 333-334; (32) both of SEQ ID NOs: 343-344; (33) both of SEQ ID NOs: 353-354; (34) both of SEQ ID NOs: 363-364; (35) both of SEQ ID NOs: 373-374; (36) both of SEQ ID NOs: 383-384; (37) both of SEQ ID NOs: 393-394; (38) both of SEQ ID NOs: 403-404; (39) both of SEQ ID NOs: 413-414; (40) both of SEQ ID NOs: 423-424; (41) both of SEQ ID NOs: 433-434; (42) both of SEQ ID NOs: 443-444; (43) both of SEQ ID NOs: 453-454; (44) both of SEQ ID NOs: 463-464; (45) both of SEQ ID NOs: 473-474; (46) both of SEQ ID NOs: 483-484; or (47) both of SEQ ID NOs: 493-494.

In an embodiment of the invention, the inventive polypeptide can further comprise the constant region of the inventive TCR set forth above. In this regard, the polypeptide can comprise the amino acid sequence of (i) one of SEQ ID NOs 23-25 or (ii) SEQ ID NO: 25 and one of SEQ ID NOs: 23-24.

In an embodiment of the invention, the inventive polypeptide may comprise an α chain and a β chain of the inventive TCR. In this regard, the polypeptide can comprise the amino acid sequences of: (1) both of SEQ ID NOs: 35-36; (2) both of SEQ ID NOs: 45-46; (3) both of SEQ ID NOs: 55-56; (4) both of SEQ ID NOs: 65-66; (5) both of SEQ ID NOs: 75-76; (6) both of SEQ ID NOs: 85-86; (7) both of SEQ ID NOs: 95-96; (8) both of SEQ ID NOs: 105-106; (9) both of SEQ ID NOs: 115-116; (10) both of SEQ ID NOs: 125-126; (11) both of SEQ ID NOs: 135-136; (12) both of SEQ ID NOs: 145-146; (13) both of SEQ ID NOs: 155-156; (14) both of SEQ ID NOs: 165-166; (15) both of SEQ ID NOs: 175-176; (16) both of SEQ ID NOs: 185-186; (17) both of SEQ ID NOs: 195-196; (18) both of SEQ ID NOs: 205-206; (19) both of SEQ ID NOs: 215-216; (20) both of SEQ ID NOs: 225-226; (21) both of SEQ ID NOs: 235-236; (22) both of SEQ ID NOs: 245-246; (23) both of SEQ ID NOs: 255-256; (24) both of SEQ ID NOs: 265-266; (25) both of SEQ ID NOs: 275-276; (26) both of SEQ ID NOs: 285-286; (27) both of SEQ ID NOs: 295-296; (28) both of SEQ ID NOs: 305-306; (29) both of SEQ ID NOs: 315-316; (30) both of SEQ ID NOs: 325-326; (31) both of SEQ ID NOs: 335-336; (32) both of SEQ ID NOs: 345-346; (33) both of SEQ ID NOs: 355-356; (34) both of SEQ ID NOs: 365-366; (35) both of SEQ ID NOs: 375-376; (36) both of SEQ ID NOs: 385-386; (37) both of SEQ ID NOs: 395-396; (38) both of SEQ ID NOs: 405-406; (39) both of SEQ ID NOs: 415-416; (40) both of SEQ ID NOs: 425-426; (41) both of SEQ ID NOs: 435-436; (42) both of SEQ ID NOs: 445-446; (43) both of SEQ ID NOs: 455-456; (44) both of SEQ ID NOs: 465-466; (45) both of SEQ ID NOs: 475-476; (46) both of SEQ ID NOs: 485-486; or (47) both of SEQ ID NOs: 495-496.

The invention further provides a protein comprising at least one of the polypeptides described herein. By "protein" is meant a molecule comprising one or more polypeptide chains. In an embodiment, the protein of the invention can comprise: (1) a first polypeptide chain comprising the amino acid sequences of all of SEQ ID NOs: 27-29 and a second polypeptide chain comprising the amino acid sequences of all of SEQ ID NOs: 30-32; (2) a first polypeptide chain comprising the amino acid sequences of all of SEQ ID NOs: 37-39 and a second polypeptide chain comprising the amino acid sequences of all of SEQ ID NOs: 40-42; (3) a first polypeptide chain comprising the amino acid sequences of all of SEQ ID NOs: 47-49 and a second polypeptide chain comprising the amino acid sequences of all of SEQ ID NOs: 50-52; (4) a first polypeptide chain comprising the amino acid sequences of all of SEQ ID NOs: 57-59 and a second polypeptide chain comprising the amino acid sequences of all of SEQ ID NOs: 60-62; (5) a first polypeptide chain comprising the amino acid sequences of all of SEQ ID NOs: 67-69 and a second polypeptide chain comprising the amino acid sequences of all of SEQ ID NOs: 70-72; (6) a first polypeptide chain comprising the amino acid sequences of all of SEQ ID NOs: 77-79 and a second polypeptide chain comprising the amino acid sequences of all of SEQ ID NOs: 80-82; (7) a first polypeptide chain comprising the amino acid sequences of all of SEQ ID NOs: 87-89 and a second polypeptide chain comprising the amino acid sequences of all of SEQ ID NOs: 90-92; (8) a first polypeptide chain comprising the amino acid sequences of all of SEQ ID NOs: 97-99 and a second polypeptide chain comprising the amino acid sequences of all of SEQ ID NOs: 100-102; (9) a first polypeptide chain comprising the amino acid sequences of all of SEQ ID NOs: 107-109 and a second polypeptide chain comprising the amino acid sequences of all of SEQ ID NOs: 110-112; (10) a first polypeptide chain comprising the amino acid sequences of all of SEQ ID NOs: 117-119 and a second polypeptide chain comprising the amino acid sequences of all of SEQ ID NOs: 120-122; (11) a first polypeptide chain comprising the amino acid sequences of all of SEQ ID NOs: 127-129 and a second polypeptide chain comprising the amino acid sequences of all of SEQ ID NOs: 130-132; (12) a first polypeptide chain comprising the amino acid sequences of all of SEQ ID NOs: 137-139 and a second polypeptide chain comprising the amino acid sequences of all of SEQ ID NOs: 140-142; (13) a first polypeptide chain comprising the amino acid sequences of all of SEQ ID NOs: 147-149 and a second polypeptide chain comprising the amino acid sequences of all of SEQ ID NOs: 150-152; (14) a first polypeptide chain comprising the amino acid sequences of all of SEQ ID NOs: 157-159 and a second polypeptide chain comprising the amino acid sequences of all of SEQ ID NOs: 160-162; (15) a first polypeptide chain comprising the amino acid sequences of all of SEQ ID NOs: 167-169 and a second polypeptide chain comprising the amino acid sequences of all of SEQ ID NOs: 170-172; (16) a first polypeptide chain comprising the amino acid sequences of all of SEQ ID NOs: 177-179 and a second polypeptide chain comprising the amino acid sequences of all of SEQ ID NOs: 180-182; (17) a first polypeptide chain comprising the amino acid sequences of all of SEQ ID NOs: 187-189 and a second polypeptide chain comprising the amino acid sequences of all of SEQ ID NOs: 190-192; (18) a first polypeptide chain comprising the amino acid sequences of all of SEQ ID NOs: 197-199 and a second polypeptide chain comprising the amino acid sequences of all of SEQ ID NOs: 200-202; (19) a first polypeptide chain comprising the amino acid sequences of all of SEQ ID NOs: 207-209 and a second polypeptide chain comprising the amino acid sequences of all of SEQ ID NOs: 210-212; (20) a first polypeptide chain comprising the amino acid sequences of all of SEQ ID NOs: 217-219 and a second polypeptide chain comprising the amino acid sequences of all of SEQ ID NOs: 220-222; (21) a first polypeptide chain comprising the amino acid sequences of all of SEQ ID NOs: 227-229 and a second polypeptide chain comprising the amino acid sequences of all of SEQ ID NOs: 230-232; (22) a first polypeptide chain comprising the amino acid sequences of all of SEQ ID NOs: 237-239 and a second polypeptide chain comprising the amino acid sequences of all of SEQ ID NOs: 240-242; (23) a first polypeptide chain comprising the amino acid sequences of all of SEQ ID NOs: 247-249 and a second polypeptide chain comprising the amino acid sequences of all of SEQ ID NOs: 250-252; (24) a first polypeptide chain comprising the amino acid sequences of all of SEQ ID NOs: 257-259 and a second polypeptide chain comprising the amino acid sequences of all of SEQ ID NOs: 260-262; (25) a first polypeptide chain comprising the amino acid sequences of all of SEQ ID NOs: 267-269 and a second polypeptide chain comprising the amino acid sequences of all of SEQ ID NOs: 270-272; (26) a first polypeptide chain comprising the amino acid sequences of all of SEQ ID NOs: 277-279 and a second polypeptide chain comprising the amino acid sequences of all of SEQ ID NOs: 280-282; (27) a first polypeptide chain comprising the amino acid sequences of all of SEQ ID NOs: 287-289 and a second polypeptide chain comprising the amino acid sequences of all of SEQ ID NOs: 290-292; (28) a first polypeptide chain comprising the amino acid sequences of all of SEQ ID NOs: 297-299 and a second polypeptide chain comprising the amino acid sequences of all of SEQ ID NOs: 300-302; (29) a first polypeptide chain comprising the amino acid sequences of all of SEQ ID NOs: 307-309 and a second polypeptide chain comprising the amino acid sequences of all of SEQ ID NOs: 310-312; (30) a first polypeptide chain comprising the amino acid sequences of all of SEQ ID NOs: 317-319 and a second polypeptide chain comprising the amino acid sequences of all of SEQ ID NOs: 320-322; (31) a first polypeptide chain comprising the amino acid sequences of all of SEQ ID NOs: 327-329 and a second polypeptide chain comprising the amino acid sequences of all of SEQ ID NOs: 330-332; (32) a first polypeptide chain comprising the amino acid sequences of all of SEQ ID NOs: 337-339 and a second polypeptide chain comprising the amino acid sequences of all of SEQ ID NOs: 340-342; (33) a first polypeptide chain comprising the amino acid sequences of all of SEQ ID NOs: 347-349 and a second polypeptide chain comprising the amino acid sequences of all of SEQ ID NOs: 350-352; (34) a first polypeptide chain comprising the amino acid sequences of all of SEQ ID NOs: 357-359 and a second polypeptide chain comprising the amino acid sequences of all of SEQ ID NOs: 360-362; (35) a first polypeptide chain comprising the amino acid sequences of all of SEQ ID NOs: 367-369 and a second polypeptide chain comprising the amino acid sequences of all of SEQ ID NOs: 370-372; (36) a first polypeptide chain comprising the amino acid sequences of all of SEQ ID NOs: 377-379 and a second polypeptide chain comprising the amino acid sequences of all of SEQ ID NOs: 380-382; (37) a first polypeptide chain comprising the amino acid sequences of all of SEQ ID NOs: 387-389 and a second polypeptide chain comprising the amino acid sequences of all of SEQ ID NOs: 390-392; (38) a first polypeptide chain comprising the amino acid sequences of all of SEQ ID NOs: 397-399 and a second polypeptide chain comprising the amino acid sequences of all of SEQ ID NOs: 400-402; (39) a first polypeptide chain comprising the amino acid sequences of all of SEQ ID NOs: 407-409 and a second polypeptide chain comprising the amino acid sequences of all of SEQ ID NOs: 410-412; (40) a first polypeptide chain comprising the amino acid sequences of all of SEQ ID NOs: 417-419 and a second polypeptide chain comprising the amino acid sequences of all of SEQ ID NOs: 420-422; (41) a first polypeptide chain comprising the amino acid sequences of all of SEQ ID NOs: 427-429 and a second polypeptide chain comprising the amino acid sequences of all of SEQ ID NOs: 430-432; (42) a first polypeptide chain comprising the amino acid sequences of all of SEQ ID NOs: 437-439 and a second polypeptide chain comprising the amino acid sequences of all of SEQ ID NOs: 440-442; (43) a first polypeptide chain comprising the amino acid sequences of all of SEQ ID NOs: 447-449 and a second polypeptide chain comprising the amino acid sequences of all of SEQ ID NOs: 450-452; (44) a first polypeptide chain comprising the amino acid sequences of all of SEQ ID NOs: 457-459 and a second polypeptide chain comprising the amino acid sequences of all of SEQ ID NOs: 460-462; (45) a first polypeptide chain comprising the amino acid sequences of all of SEQ ID NOs: 467-469 and a second polypeptide chain comprising the amino acid sequences of all of SEQ ID NOs: 470-472; (46) a first polypeptide chain comprising the amino acid sequences of all of SEQ ID NOs: 477-479 and a second polypeptide chain comprising the amino acid sequences of all of SEQ ID NOs: 480-482; or (47) a first polypeptide chain comprising the amino acid sequences of all of SEQ ID NOs: 487-489 and a second polypeptide chain comprising the amino acid sequences of all of SEQ ID NOs: 490-492.

In an embodiment of the invention, the protein comprises: (1) a first polypeptide chain comprising the amino acid sequence of SEQ ID NO: 33 and a second polypeptide chain comprising the amino acid sequence of SEQ ID NO: 34; (2) a first polypeptide chain comprising the amino acid sequence of SEQ ID NO: 43 and a second polypeptide chain comprising the amino acid sequence of SEQ ID NO: 44; (3) a first polypeptide chain comprising the amino acid sequence of SEQ ID NO: 53 and a second polypeptide chain comprising the amino acid sequence of SEQ ID NO: 54; (4) a first polypeptide chain comprising the amino acid sequence of SEQ ID NO: 63 and a second polypeptide chain comprising the amino acid sequence of SEQ ID NO: 64; (5) a first polypeptide chain comprising the amino acid sequence of SEQ ID NO: 73 and a second polypeptide chain comprising the amino acid sequence of SEQ ID NO: 74; (6) a first polypeptide chain comprising the amino acid sequence of SEQ ID NO: 83 and a second polypeptide chain comprising the amino acid sequence of SEQ ID NO: 84; (7) a first polypeptide chain comprising the amino acid sequence of SEQ ID NO: 93 and a second polypeptide chain comprising the amino acid sequence of SEQ ID NO: 94; (8) a first polypeptide chain comprising the amino acid sequence of SEQ ID NO: 103 and a second polypeptide chain comprising the amino acid sequence of SEQ ID NO: 104; (9) a first polypeptide chain comprising the amino acid sequence of SEQ ID NO: 113 and a second polypeptide chain comprising the amino acid sequence of SEQ ID NO: 114; (10) a first polypeptide chain comprising the amino acid sequence of SEQ ID NO: 123 and a second polypeptide chain comprising the amino acid sequence of SEQ ID NO: 124; (11) a first polypeptide chain comprising the amino acid sequence of SEQ ID NO: 133 and a second polypeptide chain comprising the amino acid sequence of SEQ ID NO: 134; (12) a first polypeptide chain comprising the amino acid sequence of SEQ ID NO: 143 and a second polypeptide chain comprising the amino acid sequence of SEQ ID NO: 144; (13) a first polypeptide chain comprising the amino acid sequence of SEQ ID NO: 153 and a second polypeptide chain comprising the amino acid sequence of SEQ ID NO: 154; (14) a first polypeptide chain comprising the amino acid sequence of SEQ ID NO: 163 and a second polypeptide chain comprising the amino acid sequence of SEQ ID NO: 164; (15) a first polypeptide chain comprising the amino acid sequence of SEQ ID NO: 173 and a second polypeptide chain comprising the amino acid sequence of SEQ ID NO: 174; (16) a first polypeptide chain comprising the amino acid sequence of SEQ ID NO: 183 and a second polypeptide chain comprising the amino acid sequence of SEQ ID NO: 184; (17) a first polypeptide chain comprising the amino acid sequence of SEQ ID NO: 193 and a second polypeptide chain comprising the amino acid sequence of SEQ ID NO: 194; (18) a first polypeptide chain comprising the amino acid sequence of SEQ ID NO: 203 and a second polypeptide chain comprising the amino acid sequence of SEQ ID NO: 204; (19) a first polypeptide chain comprising the amino acid sequence of SEQ ID NO: 213 and a second polypeptide chain comprising the amino acid sequence of SEQ ID NO: 214; (20) a first polypeptide chain comprising the amino acid sequence of SEQ ID NO: 223 and a second polypeptide chain comprising the amino acid sequence of SEQ ID NO: 224; (21) a first polypeptide chain comprising the amino acid sequence of SEQ ID NO: 233 and a second polypeptide chain comprising the amino acid sequence of SEQ ID NO: 234; (22) a first polypeptide chain comprising the amino acid sequence of SEQ ID NO: 243 and a second polypeptide chain comprising the amino acid sequence of SEQ ID NO: 244; (23) a first polypeptide chain comprising the amino acid sequence of SEQ ID NO: 253 and a second polypeptide chain comprising the amino acid sequence of SEQ ID NO: 254; (24) a first polypeptide chain comprising the amino acid sequence of SEQ ID NO: 263 and a second polypeptide chain comprising the amino acid sequence of SEQ ID NO: 264; (25) a first polypeptide chain comprising the amino acid sequence of SEQ ID NO: 273 and a second polypeptide chain comprising the amino acid sequence of SEQ ID NO: 274; (26) a first polypeptide chain comprising the amino acid sequence of SEQ ID NO: 283 and a second polypeptide chain comprising the amino acid sequence of SEQ ID NO: 284; (27) a first polypeptide chain comprising the amino acid sequence of SEQ ID NO: 293 and a second polypeptide chain comprising the amino acid sequence of SEQ ID NO: 294; (28) a first polypeptide chain comprising the amino acid sequence of SEQ ID NO: 303 and a second polypeptide chain comprising the amino acid sequence of SEQ ID NO: 304; (29) a first polypeptide chain comprising the amino acid sequence of SEQ ID NO: 313 and a second polypeptide chain comprising the amino acid sequence of SEQ ID NO: 314; (30) a first polypeptide chain comprising the amino acid sequence of SEQ ID NO: 323 and a second polypeptide chain comprising the amino acid sequence of SEQ ID NO: 324; (31) a first polypeptide chain comprising the amino acid sequence of SEQ ID NO: 333 and a second polypeptide chain comprising the amino acid sequence of SEQ ID NO: 334; (32) a first polypeptide chain comprising the amino acid sequence of SEQ ID NO: 343 and a second polypeptide chain comprising the amino acid sequence of SEQ ID NO: 344; (33) a first polypeptide chain comprising the amino acid sequence of SEQ ID NO: 353 and a second polypeptide chain comprising the amino acid sequence of SEQ ID NO: 354; (34) a first polypeptide chain comprising the amino acid sequence of SEQ ID NO: 363 and a second polypeptide chain comprising the amino acid sequence of SEQ ID NO: 364; (35) a first polypeptide chain comprising the amino acid sequence of SEQ ID NO: 373 and a second polypeptide chain comprising the amino acid sequence of SEQ ID NO: 374; (36) a first polypeptide chain comprising the amino acid sequence of SEQ ID NO: 383 and a second polypeptide chain comprising the amino acid sequence of SEQ ID NO: 384; (37) a first polypeptide chain comprising the amino acid sequence of SEQ ID NO: 393 and a second polypeptide chain comprising the amino acid sequence of SEQ ID NO: 394; (38) a first polypeptide chain comprising the amino acid sequence of SEQ ID NO: 403 and a second polypeptide chain comprising the amino acid sequence of SEQ ID NO: 404; (39) a first polypeptide chain comprising the amino acid sequence of SEQ ID NO: 413 and a second polypeptide chain comprising the amino acid sequence of SEQ ID NO: 414; (40) a first polypeptide chain comprising the amino acid sequence of SEQ ID NO: 423 and a second polypeptide chain comprising the amino acid sequence of SEQ ID NO: 424; (41) a first polypeptide chain comprising the amino acid sequence of SEQ ID NO: 433 and a second polypeptide chain comprising the amino acid sequence of SEQ ID NO: 434; (42) a first polypeptide chain comprising the amino acid sequence of SEQ ID NO: 443 and a second polypeptide chain comprising the amino acid sequence of SEQ ID NO: 444; (43) a first polypeptide chain comprising the amino acid sequence of SEQ ID NO: 453 and a second polypeptide chain comprising the amino acid sequence of SEQ ID NO: 454; (44) a first polypeptide chain comprising the amino acid sequence of SEQ ID NO: 463 and a second polypeptide chain comprising the amino acid sequence of SEQ ID NO: 464; (45) a first polypeptide chain comprising the amino acid sequence of SEQ ID NO: 473 and a second polypeptide chain comprising the amino acid sequence of SEQ ID NO: 474; (46) a first polypeptide chain comprising the amino acid sequence of SEQ ID NO: 483 and a second polypeptide chain comprising the amino acid sequence of SEQ ID NO: 484; or (47) a first polypeptide chain comprising the amino acid sequence of SEQ ID NO: 493 and a second polypeptide chain comprising the amino acid sequence of SEQ ID NO: 494.

In an embodiment of the invention, the protein comprises: (1) a first polypeptide chain comprising the amino acid sequence of SEQ ID NO: 35 and a second polypeptide chain comprising the amino acid sequence of SEQ ID NO: 36; (2) a first polypeptide chain comprising the amino acid sequence of SEQ ID NO: 45 and a second polypeptide chain comprising the amino acid sequence of SEQ ID NO: 46; (3) a first polypeptide chain comprising the amino acid sequence of SEQ ID NO: 55 and a second polypeptide chain comprising the amino acid sequence of SEQ ID NO: 56; (4) a first polypeptide chain comprising the amino acid sequence of SEQ ID NO: 65 and a second polypeptide chain comprising the amino acid sequence of SEQ ID NO: 66; (5) a first polypeptide chain comprising the amino acid sequence of SEQ ID NO: 75 and a second polypeptide chain comprising the amino acid sequence of SEQ ID NO: 76; (6) a first polypeptide chain comprising the amino acid sequence of SEQ ID NO: 85 and a second polypeptide chain comprising the amino acid sequence of SEQ ID NO: 86; (7) a first polypeptide chain comprising the amino acid sequence of SEQ ID NO: 95 and a second polypeptide chain comprising the amino acid sequence of SEQ ID NO: 96; (8) a first polypeptide chain comprising the amino acid sequence of SEQ ID NO: 105 and a second polypeptide chain comprising the amino acid sequence of SEQ ID NO: 106; (9) a first polypeptide chain comprising the amino acid sequence of SEQ ID NO: 115 and a second polypeptide chain comprising the amino acid sequence of SEQ ID NO: 116; (10) a first polypeptide chain comprising the amino acid sequence of SEQ ID NO: 125 and a second polypeptide chain comprising the amino acid sequence of SEQ ID NO: 126; (11) a first polypeptide chain comprising the amino acid sequence of SEQ ID NO: 135 and a second polypeptide chain comprising the amino acid sequence of SEQ ID NO: 136; (12) a first polypeptide chain comprising the amino acid sequence of SEQ ID NO: 145 and a second polypeptide chain comprising the amino acid sequence of SEQ ID NO: 146; (13) a first polypeptide chain comprising the amino acid sequence of SEQ ID NO: 155 and a second polypeptide chain comprising the amino acid sequence of SEQ ID NO: 156; (14) a first polypeptide chain comprising the amino acid sequence of SEQ ID NO: 165 and a second polypeptide chain comprising the amino acid sequence of SEQ ID NO: 166; (15) a first polypeptide chain comprising the amino acid sequence of SEQ ID NO: 175 and a second polypeptide chain comprising the amino acid sequence of SEQ ID NO: 176; (16) a first polypeptide chain comprising the amino acid sequence of SEQ ID NO: 185 and a second polypeptide chain comprising the amino acid sequence of SEQ ID NO: 186; (17) a first polypeptide chain comprising the amino acid sequence of SEQ ID NO: 195 and a second polypeptide chain comprising the amino acid sequence of SEQ ID NO: 196; (18) a first polypeptide chain comprising the amino acid sequence of SEQ ID NO: 205 and a second polypeptide chain comprising the amino acid sequence of SEQ ID NO: 206; (19) a first polypeptide chain comprising the amino acid sequence of SEQ ID NO: 215 and a second polypeptide chain comprising the amino acid sequence of SEQ ID NO: 216; (20) a first polypeptide chain comprising the amino acid sequence of SEQ ID NO: 225 and a second polypeptide chain comprising the amino acid sequence of SEQ ID NO: 226; (21) a first polypeptide chain comprising the amino acid sequence of SEQ ID NO: 235 and a second polypeptide chain comprising the amino acid sequence of SEQ ID NO: 236; (22) a first polypeptide chain comprising the amino acid sequence of SEQ ID NO: 245 and a second polypeptide chain comprising the amino acid sequence of SEQ ID NO: 246; (23) a first polypeptide chain comprising the amino acid sequence of SEQ ID NO: 255 and a second polypeptide chain comprising the amino acid sequence of SEQ ID NO: 256; (24) a first polypeptide chain comprising the amino acid sequence of SEQ ID NO: 265 and a second polypeptide chain comprising the amino acid sequence of SEQ ID NO: 266; (25) a first polypeptide chain comprising the amino acid sequence of SEQ ID NO: 275 and a second polypeptide chain comprising the amino acid sequence of SEQ ID NO: 276; (26) a first polypeptide chain comprising the amino acid sequence of SEQ ID NO: 285 and a second polypeptide chain comprising the amino acid sequence of SEQ ID NO: 286; (27) a first polypeptide chain comprising the amino acid sequence of SEQ ID NO: 295 and a second polypeptide chain comprising the amino acid sequence of SEQ ID NO: 296; (28) a first polypeptide chain comprising the amino acid sequence of SEQ ID NO: 305 and a second polypeptide chain comprising the amino acid sequence of SEQ ID NO: 306; (29) a first polypeptide chain comprising the amino acid sequence of SEQ ID NO: 315 and a second polypeptide chain comprising the amino acid sequence of SEQ ID NO: 316; (30) a first polypeptide chain comprising the amino acid sequence of SEQ ID NO: 325 and a second polypeptide chain comprising the amino acid sequence of SEQ ID NO: 326; (31) a first polypeptide chain comprising the amino acid sequence of SEQ ID NO: 335 and a second polypeptide chain comprising the amino acid sequence of SEQ ID NO: 336; (32) a first polypeptide chain comprising the amino acid sequence of SEQ ID NO: 345 and a second polypeptide chain comprising the amino acid sequence of SEQ ID NO: 346; (33) a first polypeptide chain comprising the amino acid sequence of SEQ ID NO: 355 and a second polypeptide chain comprising the amino acid sequence of SEQ ID NO: 356; (34) a first polypeptide chain comprising the amino acid sequence of SEQ ID NO: 365 and a second polypeptide chain comprising the amino acid sequence of SEQ ID NO: 366; (35) a first polypeptide chain comprising the amino acid sequence of SEQ ID NO: 375 and a second polypeptide chain comprising the amino acid sequence of SEQ ID NO: 376; (36) a first polypeptide chain comprising the amino acid sequence of SEQ ID NO: 385 and a second polypeptide chain comprising the amino acid sequence of SEQ ID NO: 386; (37) a first polypeptide chain comprising the amino acid sequence of SEQ ID NO: 395 and a second polypeptide chain comprising the amino acid sequence of SEQ ID NO: 396; (38) a first polypeptide chain comprising the amino acid sequence of SEQ ID NO: 405 and a second polypeptide chain comprising the amino acid sequence of SEQ ID NO: 406; (39) a first polypeptide chain comprising the amino acid sequence of SEQ ID NO: 415 and a second polypeptide chain comprising the amino acid sequence of SEQ ID NO: 416; (40) a first polypeptide chain comprising the amino acid sequence of SEQ ID NO: 425 and a second polypeptide chain comprising the amino acid sequence of SEQ ID NO: 426; (41) a first polypeptide chain comprising the amino acid sequence of SEQ ID NO: 435 and a second polypeptide chain comprising the amino acid sequence of SEQ ID NO: 436; (42) a first polypeptide chain comprising the amino acid sequence of SEQ ID NO: 445 and a second polypeptide chain comprising the amino acid sequence of SEQ ID NO: 446; (43) a first polypeptide chain comprising the amino acid sequence of SEQ ID NO: 455 and a second polypeptide chain comprising the amino acid sequence of SEQ ID NO: 456; (44) a first polypeptide chain comprising the amino acid sequence of SEQ ID NO: 465 and a second polypeptide chain comprising the amino acid sequence of SEQ ID NO: 466; (45) a first polypeptide chain comprising the amino acid sequence of SEQ ID NO: 475 and a second polypeptide chain comprising the amino acid sequence of SEQ ID NO: 476; (46) a first polypeptide chain comprising the amino acid sequence of SEQ ID NO: 485 and a second polypeptide chain comprising the amino acid sequence of SEQ ID NO: 486; or (47) a first polypeptide chain comprising the amino acid sequence of SEQ ID NO: 495 and a second polypeptide chain comprising the amino acid sequence of SEQ ID NO: 496.

The protein of the invention may be a TCR. Alternatively, if the first and/or second polypeptide chain(s) of the protein further comprise(s) other amino acid sequences, e.g., an amino acid sequence encoding an immunoglobulin or a portion thereof, then the inventive protein can be a fusion protein. In this regard, the invention also provides a fusion protein comprising at least one of the inventive polypeptides described herein along with at least one other polypeptide. The other polypeptide can exist as a separate polypeptide of the fusion protein, or can exist as a polypeptide, which is expressed in frame (in tandem) with one of the inventive polypeptides described herein. The other polypeptide can encode any peptidic or proteinaceous molecule, or a portion thereof, including, but not limited to an immunoglobulin, CD3, CD4, CD8, an MHC molecule, a CD1 molecule, e.g., CD1a, CD1b, CD1c, CD1d, etc.

The fusion protein can comprise one or more copies of the inventive polypeptide and/or one or more copies of the other polypeptide. For instance, the fusion protein can comprise 1, 2, 3, 4, 5, or more, copies of the inventive polypeptide and/or of the other polypeptide. Suitable methods of making fusion proteins are known in the art, and include, for example, recombinant methods.

In some embodiments of the invention, the TCRs, polypeptides, and proteins of the invention may be expressed as a single protein comprising a linker peptide linking the α chain and the p chain. In this regard, the TCRs, polypeptides, and proteins of the invention may further comprise a linker peptide. The linker peptide may advantageously facilitate the expression of a recombinant TCR, polypeptide, and/or protein in a host cell. The linker peptide may comprise any suitable amino acid sequence. For example, the linker peptide may comprise the amino acid sequence of SEQ ID NO: 26. Upon expression of the construct including the linker peptide by a host cell, the linker peptide may be cleaved, resulting in separated α and β chains. In an embodiment of the invention, the TCR, polypeptide, or protein may comprise an amino acid sequence comprising a full-length α chain, a full-length p chain, and a linker peptide positioned between the α and β chains.

The protein of the invention can be a recombinant antibody, or an antigen binding portion thereof, comprising at least one of the inventive polypeptides described herein. As used herein, "recombinant antibody" refers to a recombinant (e.g., genetically engineered) protein comprising at least one of the polypeptides of the invention and a polypeptide chain of an antibody, or an antigen binding portion thereof. The polypeptide of an antibody, or antigen binding portion thereof, can be a heavy chain, a light chain, a variable or constant region of a heavy or light chain, a single chain variable fragment (scFv), or an Fc, Fab, or F(ab)$_2$' fragment of an antibody, etc. The polypeptide chain of an antibody, or an antigen binding portion thereof, can exist as a separate polypeptide of the recombinant antibody. Alternatively, the polypeptide chain of an antibody, or an antigen binding portion thereof, can exist as a polypeptide, which is expressed in frame (in tandem) with the polypeptide of the invention. The polypeptide of an antibody, or an antigen binding portion thereof, can be a polypeptide of any antibody or any antibody fragment, including any of the antibodies and antibody fragments described herein.

The TCRs, polypeptides, and proteins of the invention can be of any length, i.e., can comprise any number of amino acids, provided that the TCRs, polypeptides, or proteins retain their biological activity, e.g., the ability to specifically bind to mutated p53; detect cancer in a mammal; or treat or prevent cancer in a mammal, etc. For example, the polypeptide can be in the range of from about 50 to about 5000 amino acids long, such as 50, 70, 75, 100, 125, 150, 175, 200, 300, 400, 500, 600, 700, 800, 900, 1000 or more amino acids in length. In this regard, the polypeptides of the invention also include oligopeptides.

The TCRs, polypeptides, and proteins of the invention of the invention can comprise synthetic amino acids in place of one or more naturally-occurring amino acids. Such synthetic amino acids are known in the art, and include, for example, aminocyclohexane carboxylic acid, norleucine, α-amino n-decanoic acid, homoserine, S-acetylaminomethyl-cysteine, trans-3- and trans-4-hydroxyproline, 4-aminophenylalanine, 4-nitrophenylalanine, 4-chlorophenylalanine, 4-carboxyphenylalanine, β-phenylserine β-hydroxyphenylalanine, phenylglycine, α-naphthylalanine, cyclohexylalanine, cyclohexylglycine, indoline-2-carboxylic acid, 1,2,3,4-tetrahydroisoquinoline-3-carboxylic acid, aminomalonic acid, aminomalonic acid monoamide, N'-benzyl-N'-methyllysine, N',N'-dibenzyl-lysine, 6-hydroxylysine, ornithine, α-aminocyclopentane carboxylic acid, α-aminocyclohexane carboxylic acid, α-aminocycloheptane carboxylic acid, α-(2-amino-2-norbornane)-carboxylic acid, α,γ-diaminobutyric acid, α,β-diaminopropionic acid, homophenylalanine, and α-tert-butylglycine.

The TCRs, polypeptides, and proteins of the invention can be glycosylated, amidated, carboxylated, phosphorylated, esterified, N-acylated, cyclized via, e.g., a disulfide bridge, or converted into an acid addition salt and/or optionally dimerized or polymerized, or conjugated.

The TCR, polypeptide, and/or protein of the invention can be obtained by methods known in the art such as, for example, de novo synthesis. Also, polypeptides and proteins can be recombinantly produced using the nucleic acids described herein using standard recombinant methods. See, for instance, Green and Sambrook, *Molecular Cloning: A Laboratory Manual*, 4$^{th}$ ed., Cold Spring Harbor Press, Cold Spring Harbor, NY (2012). Alternatively, the TCRs, polypeptides, and/or proteins described herein can be commercially synthesized by companies, such as Synpep (Dublin, CA), Peptide Technologies Corp. (Gaithersburg, MD), and Multiple Peptide Systems (San Diego, CA). In this respect, the inventive TCRs, polypeptides, and proteins can be synthetic, recombinant, isolated, and/or purified.

An embodiment of the invention provides a nucleic acid comprising a nucleotide sequence encoding any of the TCRs, polypeptides, or proteins described herein. "Nucleic acid," as used herein, includes "polynucleotide," "oligonucleotide," and "nucleic acid molecule," and generally means a polymer of DNA or RNA, which can be single-stranded or double-stranded, which can contain natural, non-natural or altered nucleotides, and which can contain a natural, non-natural or altered internucleotide linkage, such as a phosphoroamidate linkage or a phosphorothioate linkage, instead of the phosphodiester found between the nucleotides of an unmodified oligonucleotide. In an embodiment, the nucleic acid comprises complementary DNA (cDNA). It is generally preferred that the nucleic acid does not comprise any insertions, deletions, inversions, and/or substitutions. However, it may be suitable in some instances, as discussed herein, for the nucleic acid to comprise one or more insertions, deletions, inversions, and/or substitutions.

Preferably, the nucleic acids of the invention are recombinant. As used herein, the term "recombinant" refers to (i) molecules that are constructed outside living cells by joining natural or synthetic nucleic acid segments to nucleic acid molecules that can replicate in a living cell, or (ii) molecules that result from the replication of those described in (i) above. For purposes herein, the replication can be in vitro replication or in vivo replication.

The nucleic acids can be constructed based on chemical synthesis and/or enzymatic ligation reactions using procedures known in the art. See, for example, Green and Sambrook et al., supra. For example, a nucleic acid can be chemically synthesized using naturally occurring nucleotides or variously modified nucleotides designed to increase the biological stability of the molecules or to increase the physical stability of the duplex formed upon hybridization (e.g., phosphorothioate derivatives and acridine substituted nucleotides). Examples of modified nucleotides that can be used to generate the nucleic acids include, but are not limited to, 5-fluorouracil, 5-bromouracil, 5-chlorouracil, 5-iodouracil, hypoxanthine, xanthine, 4-acetylcytosine, 5-(carboxyhydroxymethyl) uracil, 5-carboxymethylaminomethyl-2-thiouridine, 5-carboxymethylaminomethyluracil, dihydrouracil, beta-D-galactosylqueosine, inosine, $N^6$-isopentenyladenine, I-methylguanine, 1-methylinosine, 2,2-dimethylguanine, 2-methyladenine, 2-methylguanine, 3-methylcytosine, 5-methylcytosine, $N^6$-substituted adenine, 7-methylguanine, 5-methylaminomethyluracil, 5-methoxyaminomethyl-2-thiouracil, beta-D-mannosylqueosine, 5'-methoxycarboxymethyluracil, 5-methoxyuracil, 2-methylthio-$N^6$-isopentenyladenine, uracil-5-oxyacetic acid (v), wybutoxosine, pseudouracil, queosine, 2-thiocytosine, 5-methyl-2-thiouracil, 2-thiouracil, 4-thiouracil, 5-methyluracil, uracil-5-oxyacetic acid methylester, 3-(3-amino-3-N-2-carboxypropyl) uracil, and 2,6-diaminopurine. Alternatively, one or more of the nucleic acids of the invention can be purchased from companies, such as Macromolecular Resources (Fort Collins, CO) and Synthegen (Houston, TX).

In an embodiment of the invention, the nucleic acid comprises a codon-optimized nucleotide sequence encoding any of the TCRs, polypeptides, or proteins described herein. Without being bound to any particular theory or mechanism, it is believed that codon optimization of the nucleotide sequence increases the translation efficiency of the mRNA transcripts. Codon optimization of the nucleotide sequence may involve substituting a native codon for another codon that encodes the same amino acid, but can be translated by tRNA that is more readily available within a cell, thus increasing translation efficiency. Optimization of the nucleotide sequence may also reduce secondary mRNA structures that would interfere with translation, thus increasing translation efficiency.

The invention also provides a nucleic acid comprising a nucleotide sequence which is complementary to the nucleotide sequence of any of the nucleic acids described herein or a nucleotide sequence which hybridizes under stringent conditions to the nucleotide sequence of any of the nucleic acids described herein.

The nucleotide sequence which hybridizes under stringent conditions preferably hybridizes under high stringency conditions. By "high stringency conditions" is meant that the nucleotide sequence specifically hybridizes to a target sequence (the nucleotide sequence of any of the nucleic acids described herein) in an amount that is detectably stronger than non-specific hybridization. High stringency conditions include conditions which would distinguish a polynucleotide with an exact complementary sequence, or one containing only a few scattered mismatches from a random sequence that happened to have a few small regions (e.g., 3-10 bases) that matched the nucleotide sequence. Such small regions of complementarity are more easily melted than a full-length complement of 14-17 or more bases, and high stringency hybridization makes them easily distinguishable. Relatively high stringency conditions would include, for example, low salt and/or high temperature conditions, such as provided by about 0.02-0.1 M NaCl or the equivalent, at temperatures of about 50-70° C. Such high stringency conditions tolerate little, if any, mismatch between the nucleotide sequence and the template or target strand, and are particularly suitable for detecting expression of any of the inventive TCRs. It is generally appreciated that conditions can be rendered more stringent by the addition of increasing amounts of formamide.

The invention also provides a nucleic acid comprising a nucleotide sequence that is at least about 70% or more, e.g., about 80%, about 90%, about 91%, about 92%, about 93%, about 94%, about 95%, about 96%, about 97%, about 98%, or about 99% identical to any of the nucleic acids described herein. In this regard, the nucleic acid may consist essentially of any of the nucleotide sequences described herein.

The nucleic acids of the invention can be incorporated into a recombinant expression vector. In this regard, the invention provides a recombinant expression vector comprising any of the nucleic acids of the invention. In an embodiment of the invention, the recombinant expression vector comprises a nucleotide sequence encoding the α chain, the β chain, and linker peptide.

For purposes herein, the term "recombinant expression vector" means a genetically-modified oligonucleotide or polynucleotide construct that permits the expression of an mRNA, protein, polypeptide, or peptide by a host cell, when the construct comprises a nucleotide sequence encoding the mRNA, protein, polypeptide, or peptide, and the vector is contacted with the cell under conditions sufficient to have the mRNA, protein, polypeptide, or peptide expressed within the cell. The vectors of the invention are not naturally-occurring as a whole. However, parts of the vectors can be naturally-occurring. The inventive recombinant expression vectors can comprise any type of nucleotide, including, but not limited to DNA and RNA, which can be single-stranded or double-stranded, synthesized or obtained in part from natural sources, and which can contain natural, non-natural or altered nucleotides. The recombinant expression vectors can comprise naturally-occurring, non-naturally-occurring internucleotide linkages, or both types of linkages. Preferably, the non-naturally occurring or altered nucleotides or internucleotide linkages do not hinder the transcription or replication of the vector.

The recombinant expression vector of the invention can be any suitable recombinant expression vector, and can be used to transform or transfect any suitable host cell. Suitable vectors include those designed for propagation and expansion or for expression or both, such as plasmids and viruses. The vector can be selected from the group consisting of the transposon/transposases series, pUC series (Fermentas Life Sciences), the pBluescript series (Stratagene, LaJolla, CA), the pET series (Novagen, Madison, WI), the pGEX series (Pharmacia Biotech, Uppsala, Sweden), and the pEX series (Clontech, Palo Alto, CA). Bacteriophage vectors, such as λGT10, λGT11, λZapII (Stratagene), λEMBL4, and λNM1149, also can be used. Examples of plant expression vectors include pBI01, pBI101.2, pBI101.3, pBI121 and pBIN19 (Clontech). Examples of animal expression vectors include pEUK-Cl, pMAM and pMAMneo (Clontech). Preferably, the recombinant expression vector is a transposon vector or a viral vector, e.g., a retroviral vector.

The recombinant expression vectors of the invention can be prepared using standard recombinant DNA techniques described in, for example, Green and Sambrook et al., supra. Constructs of expression vectors, which are circular or linear, can be prepared to contain a replication system functional in a prokaryotic or eukaryotic host cell. Replication systems can be derived, e.g., from ColE1, 2μ plasmid, λ, SV40, bovine papillomavirus, and the like.

Desirably, the recombinant expression vector comprises regulatory sequences, such as transcription and translation initiation and termination codons, which are specific to the type of host cell (e.g., bacterium, fungus, plant, or animal) into which the vector is to be introduced, as appropriate and taking into consideration whether the vector is DNA- or RNA-based.

The recombinant expression vector can include one or more marker genes, which allow for selection of transformed or transfected host cells. Marker genes include biocide resistance, e.g., resistance to antibiotics, heavy metals, etc., complementation in an auxotrophic host cell to provide prototrophy, and the like. Suitable marker genes for the inventive expression vectors include, for instance, neomycin/G418 resistance genes, hygromycin resistance genes, histidinol resistance genes, tetracycline resistance genes, and ampicillin resistance genes.

The recombinant expression vector can comprise a native or nonnative promoter operably linked to the nucleotide sequence encoding the TCR, polypeptide, or protein, or to the nucleotide sequence which is complementary to or which hybridizes to the nucleotide sequence encoding the TCR, polypeptide, or protein. The selection of promoters, e.g., strong, weak, inducible, tissue-specific and developmental-specific, is within the ordinary skill of the artisan. Similarly, the combining of a nucleotide sequence with a promoter is also within the skill of the artisan. The promoter can be a non-viral promoter, e.g., a human elongation factor-1α promoter, or a viral promoter, e.g., a cytomegalovirus (CMV) promoter, an SV40 promoter, an RSV promoter, and a promoter found in the long-terminal repeat of the murine stem cell virus.

The inventive recombinant expression vectors can be designed for either transient expression, for stable expression, or for both. Also, the recombinant expression vectors can be made for constitutive expression or for inducible expression.

Further, the recombinant expression vectors can be made to include a suicide gene. As used herein, the term "suicide gene" refers to a gene that causes the cell expressing the suicide gene to die. The suicide gene can be a gene that confers sensitivity to an agent, e.g., a drug, upon the cell in which the gene is expressed, and causes the cell to die when the cell is contacted with or exposed to the agent. Suicide genes are known in the art and include, for example, the Herpes Simplex Virus (HSV) thymidine kinase (TK) gene, cytosine daminase, purine nucleoside phosphorylase, and nitroreductase.

Another embodiment of the invention further provides a host cell comprising any of the recombinant expression vectors described herein. As used herein, the term "host cell" refers to any type of cell that can contain the inventive recombinant expression vector. The host cell can be a eukaryotic cell, e.g., plant, animal, fungi, or algae, or can be a prokaryotic cell, e.g., bacteria or protozoa. The host cell can be a cultured cell or a primary cell, i.e., isolated directly from an organism, e.g., a human. The host cell can be an adherent cell or a suspended cell, i.e., a cell that grows in suspension. Suitable host cells are known in the art and include, for instance, DH5a E. coli cells, Chinese hamster ovarian cells, monkey VERO cells, COS cells, HEK293 cells, and the like. For purposes of amplifying or replicating the recombinant expression vector, the host cell is preferably a prokaryotic cell, e.g., a DH5a cell. For purposes of producing a recombinant TCR, polypeptide, or protein, the host cell is preferably a mammalian cell. Most preferably, the host cell is a human cell. While the host cell can be of any cell type, can originate from any type of tissue, and can be of any developmental stage, the host cell preferably is a peripheral blood lymphocyte (PBL) or a peripheral blood mononuclear cell (PBMC). More preferably, the host cell is a T cell.

For purposes herein, the T cell can be any T cell, such as a cultured T cell, e.g., a primary T cell, or a T cell from a cultured T cell line, e.g., Jurkat, SupT1, etc., or a T cell obtained from a mammal. If obtained from a mammal, the T cell can be obtained from numerous sources, including but not limited to blood, bone marrow, lymph node, the thymus, or other tissues or fluids. T cells can also be enriched for or purified. Preferably, the T cell is a human T cell. The T cell can be any type of T cell and can be of any developmental stage, including but not limited to, $CD4^+/CD8^+$ double positive T cells, $CD4^+$ helper T cells, e.g., $Th_1$ and $Th_2$ cells, $CD4^+$ T cells, $CD8^+$ T cells (e.g., cytotoxic T cells), tumor infiltrating lymphocytes (TILs), memory T cells (e.g., central memory T cells and effector memory T cells), naïve T cells, and the like.

Also provided by the invention is a population of cells comprising at least one host cell described herein. The population of cells can be a heterogeneous population comprising the host cell comprising any of the recombinant expression vectors described, in addition to at least one other cell, e.g., a host cell (e.g., a T cell), which does not comprise any of the recombinant expression vectors, or a cell other than a T cell, e.g., a B cell, a macrophage, a neutrophil, an erythrocyte, a hepatocyte, an endothelial cell, an epithelial cells, a muscle cell, a brain cell, etc. Alternatively, the population of cells can be a substantially homogeneous population, in which the population comprises mainly of host cells (e.g., consisting essentially of) comprising the recombinant expression vector. The population also can be a clonal population of cells, in which all cells of the population are clones of a single host cell comprising a recombinant expression vector, such that all cells of the population comprise the recombinant expression vector. In one embodiment of the invention, the population of cells is a clonal population comprising host cells comprising a recombinant expression vector as described herein.

In an embodiment of the invention, the numbers of cells in the population may be rapidly expanded. Expansion of the numbers of T cells can be accomplished by any of a number of methods as are known in the art as described in, for example, U.S. Pat. Nos. 8,034,334; 8,383,099; U.S. Patent Application Publication No. 2012/0244133; Dudley et al., J. Immunother., 26:332-42 (2003); and Riddell et al., J. Immunol. Methods, 128:189-201 (1990). In an embodiment, expansion of the numbers of T cells is carried out by culturing the T cells with OKT3 antibody, IL-2, and feeder PBMC (e.g., irradiated allogeneic PBMC).

The inventive TCRs, polypeptides, proteins, nucleic acids, recombinant expression vectors, and host cells (including populations thereof), can be isolated and/or purified. The term "isolated" as used herein means having been removed from its natural environment. The term "purified" as used herein means having been increased in purity, wherein "purity" is a relative term, and not to be necessarily construed as absolute purity. For example, the purity can be at least about 50%, at least about 60%, at least about 70%, at least about 80%, at least about 90%, at least about 95%, or can be about 100%.

The inventive TCRs, polypeptides, proteins, nucleic acids, recombinant expression vectors, and host cells (including populations thereof), all of which are collectively referred to as "inventive TCR materials" hereinafter, can be formulated into a composition, such as a pharmaceutical composition. In this regard, the invention provides a pharmaceutical composition comprising any of the TCRs, polypeptides, proteins, nucleic acids, expression vectors, and host cells (including populations thereof), described herein, and a pharmaceutically acceptable carrier. The inventive pharmaceutical compositions containing any of the inventive TCR materials can comprise more than one inventive TCR material, e.g., a polypeptide and a nucleic acid, or two or more different TCRs. Alternatively, the pharmaceutical composition can comprise an inventive TCR material in combination with another pharmaceutically active agent(s) or drug(s), such as a chemotherapeutic agents, e.g., asparaginase, busulfan, carboplatin, cisplatin, daunorubicin, doxorubicin, fluorouracil, gemcitabine, hydroxyurea, methotrexate, paclitaxel, rituximab, vinblastine, vincristine, etc.

Preferably, the carrier is a pharmaceutically acceptable carrier. With respect to pharmaceutical compositions, the carrier can be any of those conventionally used for the particular inventive TCR material under consideration. Methods for preparing administrable compositions are known or apparent to those skilled in the art and are described in more detail in, for example, *Remington: The Science and Practice of Pharmacy*, $22^{nd}$ Ed., Pharmaceutical Press (2012). It is preferred that the pharmaceutically acceptable carrier be one which has no detrimental side effects or toxicity under the conditions of use.

The choice of carrier will be determined in part by the particular inventive TCR material, as well as by the particular method used to administer the inventive TCR material. Accordingly, there are a variety of suitable formulations of the pharmaceutical composition of the invention. Suitable formulations may include any of those for parenteral, subcutaneous, intravenous, intramuscular, intraarterial, intrathecal, intratumoral, or interperitoneal administration. More than one route can be used to administer the inventive TCR materials, and in certain instances, a particular route can provide a more immediate and more effective response than another route.

Preferably, the inventive TCR material is administered by injection, e.g., intravenously. When the inventive TCR material is a host cell expressing the inventive TCR, the pharmaceutically acceptable carrier for the cells for injection may include any isotonic carrier such as, for example, normal saline (about 0.90% w/v of NaCl in water, about 300 mOsm/L NaCl in water, or about 9.0 g NaCl per liter of water), NORMOSOL® electrolyte solution (Abbott, Chicago, IL), PLASMA-LYTE A (Baxter, Deerfield, IL), about 5% dextrose in water, or Ringer's lactate. In an embodiment, the pharmaceutically acceptable carrier is supplemented with human serum albumen.

For purposes of the invention, the amount or dose (e.g., numbers of cells when the inventive TCR material is one or more cells) of the inventive TCR material administered should be sufficient to effect, e.g., a therapeutic or prophylactic response, in the subject or animal over a reasonable time frame. For example, the dose of the inventive TCR material should be sufficient to bind to a cancer antigen (e.g., mutated p53), or detect, treat or prevent cancer in a period of from about 2 hours or longer, e.g., 12 to 24 or more hours, from the time of administration. In certain embodiments, the time period could be even longer. The dose will be determined by the efficacy of the particular inventive TCR material and the condition of the animal (e.g., human), as well as the body weight of the animal (e.g., human) to be treated.

Many assays for determining an administered dose are known in the art. For purposes of the invention, an assay, which comprises comparing the extent to which target cells are lysed or IFN-γ is secreted by T cells expressing the inventive TCR, polypeptide, or protein upon administration of a given dose of such T cells to a mammal among a set of mammals of which each is given a different dose of the T cells, could be used to determine a starting dose to be administered to a mammal. The extent to which target cells are lysed or IFN-γ is secreted upon administration of a certain dose can be assayed by methods known in the art.

The dose of the inventive TCR material also will be determined by the existence, nature and extent of any adverse side effects that might accompany the administration of a particular inventive TCR material. Typically, the attending physician will decide the dosage of the inventive TCR material with which to treat each individual patient, taking into consideration a variety of factors, such as age, body weight, general health, diet, sex, inventive TCR material to be administered, route of administration, and the severity of the cancer being treated. In an embodiment in which the inventive TCR material is a population of cells, the number of cells administered per infusion may vary, e.g., from about $1 \times 10^6$ to about $1 \times 10^{12}$ cells or more. In certain embodiments, fewer than $1 \times 10^6$ cells may be administered.

One of ordinary skill in the art will readily appreciate that the inventive TCR materials of the invention can be modified in any number of ways, such that the therapeutic or prophylactic efficacy of the inventive TCR materials is increased through the modification. For instance, the inventive TCR materials can be conjugated either directly or indirectly through a bridge to a chemotherapeutic agent. The practice of conjugating compounds to a chemotherapeutic agent is known in the art. One of ordinary skill in the art recognizes that sites on the inventive TCR materials, which are not necessary for the function of the inventive TCR materials, are ideal sites for attaching a bridge and/or a chemotherapeutic agent, provided that the bridge and/or chemotherapeutic agent, once attached to the inventive TCR materials, do(es) not interfere with the function of the inventive TCR materials, i.e., the ability to bind to mutated p53 or to detect, treat, or prevent cancer.

It is contemplated that the inventive pharmaceutical compositions, TCRs, polypeptides, proteins, nucleic acids, recombinant expression vectors, host cells, or populations of cells can be used in methods of treating or preventing cancer. Without being bound to a particular theory, the inventive TCRs are believed to bind specifically to mutated p53, such that the TCR (or related inventive polypeptide or protein), when expressed by a cell, is able to mediate an immune response against a target cell expressing mutated p53. In this regard, an embodiment of the invention provides a method of treating or preventing cancer in a mammal, comprising administering to the mammal any of the pharmaceutical compositions, TCRs, polypeptides, or proteins described herein, any nucleic acid or recombinant expression vector comprising a nucleotide sequence encoding any of the TCRs, polypeptides, proteins described herein, or any host cell or population of cells comprising a recombinant vector which encodes any of the TCRs, polypeptides, or proteins described herein, in an amount effective to treat or prevent cancer in the mammal.

An embodiment of the invention provides any of the pharmaceutical compositions, TCRs, polypeptides, or proteins described herein, any nucleic acid or recombinant expression vector comprising a nucleotide sequence encoding any of the TCRs, polypeptides, proteins described herein, or any host cell or population of cells comprising a recombinant vector which encodes any of the TCRs, polypeptides, or proteins described herein, for use in the treatment or prevention of cancer in a mammal.

The terms "treat," and "prevent" as well as words stemming therefrom, as used herein, do not necessarily imply 100% or complete treatment or prevention. Rather, there are varying degrees of treatment or prevention of which one of ordinary skill in the art recognizes as having a potential benefit or therapeutic effect. In this respect, the inventive methods can provide any amount of any level of treatment or prevention of cancer in a mammal. Furthermore, the treatment or prevention provided by the inventive method can include treatment or prevention of one or more conditions or symptoms of the cancer being treated or prevented. For example, treatment or prevention can include promoting the regression of a tumor. Also, for purposes herein, "prevention" can encompass delaying the onset of the cancer, or a symptom or condition thereof. Alternatively or additionally, "prevention" may encompass preventing or delaying the recurrence of cancer, or a symptom or condition thereof.

Also provided by an embodiment of the invention is a method of detecting the presence of cancer in a mammal. The method comprises (i) contacting a sample comprising one or more cells from the mammal with any of the inventive TCRs, polypeptides, proteins, nucleic acids, recombinant expression vectors, host cells, populations of cells, or pharmaceutical compositions described herein, thereby forming a complex, and detecting the complex, wherein detection of the complex is indicative of the presence of cancer in the mammal.

With respect to the inventive method of detecting cancer in a mammal, the sample of cells can be a sample comprising whole cells, lysates thereof, or a fraction of the whole cell lysates, e.g., a nuclear or cytoplasmic fraction, a whole protein fraction, or a nucleic acid fraction.

For purposes of the inventive detecting method, the contacting can take place in vitro or in vivo with respect to the mammal. Preferably, the contacting is in vitro.

Also, detection of the complex can occur through any number of ways known in the art. For instance, the inventive TCRs, polypeptides, proteins, nucleic acids, recombinant expression vectors, host cells, or populations of cells, described herein, can be labeled with a detectable label such as, for instance, a radioisotope, a fluorophore (e.g., fluorescein isothiocyanate (FITC), phycoerythrin (PE)), an enzyme (e.g., alkaline phosphatase, horseradish peroxidase), and element particles (e.g., gold particles).

For purposes of the inventive methods, wherein host cells or populations of cells are administered, the cells can be cells that are allogeneic or autologous to the mammal. Preferably, the cells are autologous to the mammal.

With respect to the inventive methods, the cancer can be any cancer, including any of acute lymphocytic cancer, acute myeloid leukemia, alveolar rhabdomyosarcoma, bone cancer, brain cancer, breast cancer, cancer of the anus, anal canal, or anorectum, cancer of the eye, cancer of the intrahepatic bile duct, cancer of the joints, cancer of the neck, gallbladder, or pleura, cancer of the nose, nasal cavity, or middle ear, cancer of the oral cavity, cancer of the vagina, cancer of the vulva, chronic lymphocytic leukemia, chronic myeloid cancer, colon cancer, colorectal cancer, endometrial cancer, esophageal cancer, uterine cervical cancer, gastrointestinal carcinoid tumor, glioma, Hodgkin lymphoma, hypopharynx cancer, kidney cancer, larynx cancer, liver cancer, lung cancer, malignant mesothelioma, melanoma, multiple myeloma, nasopharynx cancer, non-Hodgkin lymphoma, cancer of the oropharynx, ovarian cancer, cancer of the penis, pancreatic cancer, peritoneum, omentum, and mesentery cancer, pharynx cancer, prostate cancer, rectal cancer, renal cancer, skin cancer, small intestine cancer, soft tissue cancer, stomach cancer, testicular cancer, thyroid cancer, cancer of the uterus, ureter cancer, and urinary bladder cancer. In a preferred embodiment, the cancer is a cancer which expresses mutated p53. The cancer may express p53 with a mutation at any one or more of positions 175, 220, 245, 248, 249, 273, and 282 of SEQ ID NO: 1. The cancer may express p53 with any one or more of the following human p53 mutations: R175H, Y220C, G245D, G245S, R248L, R248Q, R248W, R249S, R273H, R273C, R273L, and R282W. Preferably, the cancer is an epithelial cancer or cholangiocarcinoma, melanoma, colon cancer, rectal cancer, ovarian cancer, endometrial cancer, non-small cell lung cancer (NSCLC), glioblastoma, uterine cervical cancer, head and neck cancer, breast cancer, pancreatic cancer, or bladder cancer.

The mammal referred to in the inventive methods can be any mammal. As used herein, the term "mammal" refers to any mammal, including, but not limited to, mammals of the order Rodentia, such as mice and hamsters, and mammals of the order Logomorpha, such as rabbits. It is preferred that the mammals are from the order Carnivora, including Felines (cats) and Canines (dogs). It is more preferred that the mammals are from the order Artiodactyla, including Bovines (cows) and Swines (pigs) or of the order Perssodactyla, including Equines (horses). It is most preferred that the mammals are of the order Primates, Ceboids, or Simoids (monkeys) or of the order Anthropoids (humans and apes). An especially preferred mammal is the human.

The following examples further illustrate the invention but, of course, should not be construed as in any way limiting its scope.

EXAMPLES

The amino acid sequences set forth in Tables 1-3 were employed in the experiments described in the following Examples. In Tables 1-2, "LP" stands for "long peptide." In Table 3, "TMG" stands for "tandem minigene."

TABLE 1

| SEQ ID NO: | Name | Sequence |
|---|---|---|
| 2 | LP-p53-R175H-MUT | YKQSQHMTEVVRHCPHHERCSDSDG |
| 3 | LP-p53-R273H-MUT | SGNLLGRNSFEVHVCACPGRDRRTE |
| 4 | LP-p53-R248L-MUT | YMCNSSCMGGMNLRPILTIITLEDS |
| 5 | LP-p53-R282W-MUT | FEVRVCACPGRDWRTEEENLRKKGE |
| 6 | LP-p53-R273C-MUT | SGNLLGRNSFEVCVCACPGRDRRTE |
| 7 | LP-p53-G245S-MUT | HYNYMCNSSCMGSMNRRPILTIITL |
| 8 | LP-p53-R248Q-MUT | YMCNSSCMGGMNQRPILTIITLEDS |

TABLE 1-continued

| SEQ ID NO: | Name | Sequence |
|---|---|---|
| 9 | LP-p53-G245D-MUT | HYNYMCNSSCMGDMNRRPILTIITL |
| 10 | LP-p53-R273L-MUT | SGNLLGRNSFEVLVCACPGRDRRTE |
| 11 | LP-p53-R248W-MUT | YMCNSSCMGGMNWRPILTIITLEDS |
| 12 | LP-p53-Y2200-MUT | DRNTFRHSVVVPCEPPEVGSDCTTI |
| 13 | LP-p53-R249S-MUT | MCNSSCMGGMNRSPILTIITLEDSS |

The WT versions of the peptides of Table 1 are set forth in Table 2.

TABLE 2

| SEQ ID NO: | Name | Sequence |
|---|---|---|
| 15 | LP-p53-R175-WT | YKQSQHMTEVVRRCPHHERCSDSDG |
| 16 | LP-p53-R273-WT | SGNLLGRNSFEVRVCACPGRDRRTE |
| 17 | LP-p53-R248-WT | YMCNSSCMGGMNRRPILTIITLEDS |
| 18 | LP-p53-R282-WT | FEVRVCACPGRDRRTEEENLRKKGE |
| 19 | LP-p53-G245-WT | HYNYMCNSSCMGGMNRRPILTIITL |
| 20 | LP-p53-Y220-WT | DRNTFRHSVVVPYEPPEVGSDCTTI |
| 21 | LP-p53-R249-WT | MCNSSCMGGMNRRPILTIITLEDSS |

TABLE 3

| SEQ ID NO: | Name | Sequence |
|---|---|---|
| 14 | TMG-p53-MUT | YKQSQHMTEVVRHCPHHERCSDSDGSGNLLGRNSFEVHVCACP GRDRRTEYMCNSSCMGGMNLRPILTIITLEDSFEVRVCACPGRDW RTEEENLRKKGESGNLLGRNSFEVCVCACPGRDRRTEHYNYMCN SSCMGSMNRRPILTIITLYMCNSSCMGGMNQRPILTIITLEDSHYNY MCNSSCMGDMNRRPILTIITLSGNLLGRNSFEVLVCACPGRDRRT EYMCNSSCMGGMNWRPILTIITLEDSDRNTFRHSVVVPCEPPEVG SDCTTIMCNSSCMGGMNRSPILTIITLEDSS |
| 22 | TMG-p53-WT | YKQSQHMTEVVRRCPHHERCSDSDGSGNLLGRNSFEVRVCACP GRDRRTEYMCNSSCMGGMNRRPILTIITLEDSFEVRVCACPGRDR RTEEENLRKKGESGNLLGRNSFEVRVCACPGRDRRTEHYNYMCN SSCMGGMNRRPILTIITLYMCNSSCMGGMNRRPILTIITLEDSHYNY MCNSSCMGGMNRRPILTIITLSGNLLGRNSFEVRVCACPGRDRRT EYMCNSSCMGGMNRRPILTIITLEDSDRNTFRHSVVVPYEPPEVG SDCTTIMCNSSCMGGMNRRPILTIITLEDSS |

Example 1

This example demonstrates the isolation and specific reactivity of four anti-mutated p53 TCRs from patient 4127.

Experiments were carried out as described for FIGS. 1-7, 36, and 37A-37C for Patient 4127. The mutated p53 reactive T cells for this patient were identified by the method described in U.S. Patent Application Number 2017/0224800 ("Tran method"). The methods for isolating the individual TCRs are set forth below.

Figure 1:
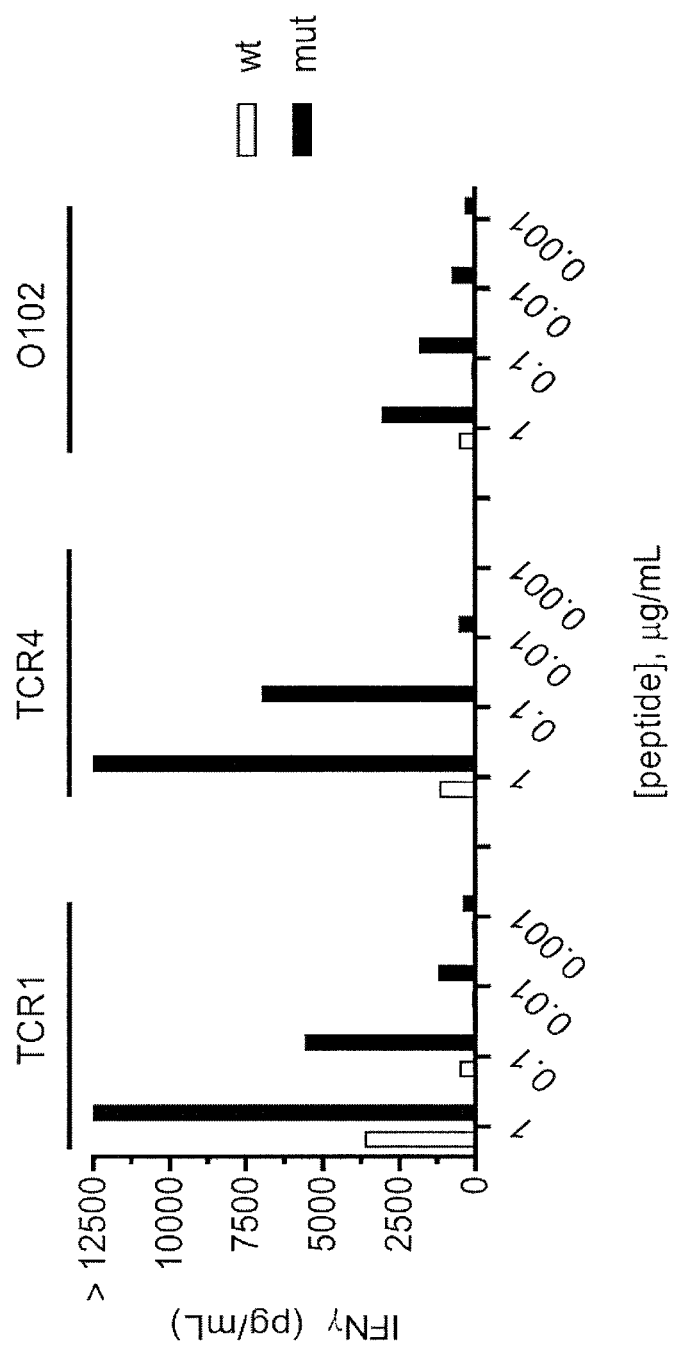
FIG. 1 is a graph showing the concentration of IFN-γ (pg/mL) measured following co-culture of autologous PBL transduced with one of the indicated TCRs from patient 4127 following co-culture with autologous dendritic cells (DCs) pulsed with either WT p53-G245 peptide (wt) (unshaded bars) or mutated p53-G245S peptide (mut) (shaded bars) at the indicated decreasing peptide concentrations (μg/mL).

Autologous PBL were transduced with one of the TCRs shown in FIG. 1 and were tested 2 weeks later. Autologous DC cells were plated at 3×10⁴ cells/well and pulsed overnight with either WT p53-G245 peptide (wt) or mutated p53-G245S peptide (mut) at decreasing peptide concentrations. 3×10⁴ transduced T cells were added per well and co-cultured overnight at 37° C. Supernatants were harvested for IFN-γ ELISA. The IFN-γ ELISA results are shown in FIG. 1. 4-1BB expression was measured by FACS gate: lymphocytes\PI(neg)CD3⁺\CD3⁺mTCR⁺\CD8(neg)CD4⁺. The FACS results are shown in FIG. 2.

Figure 2:
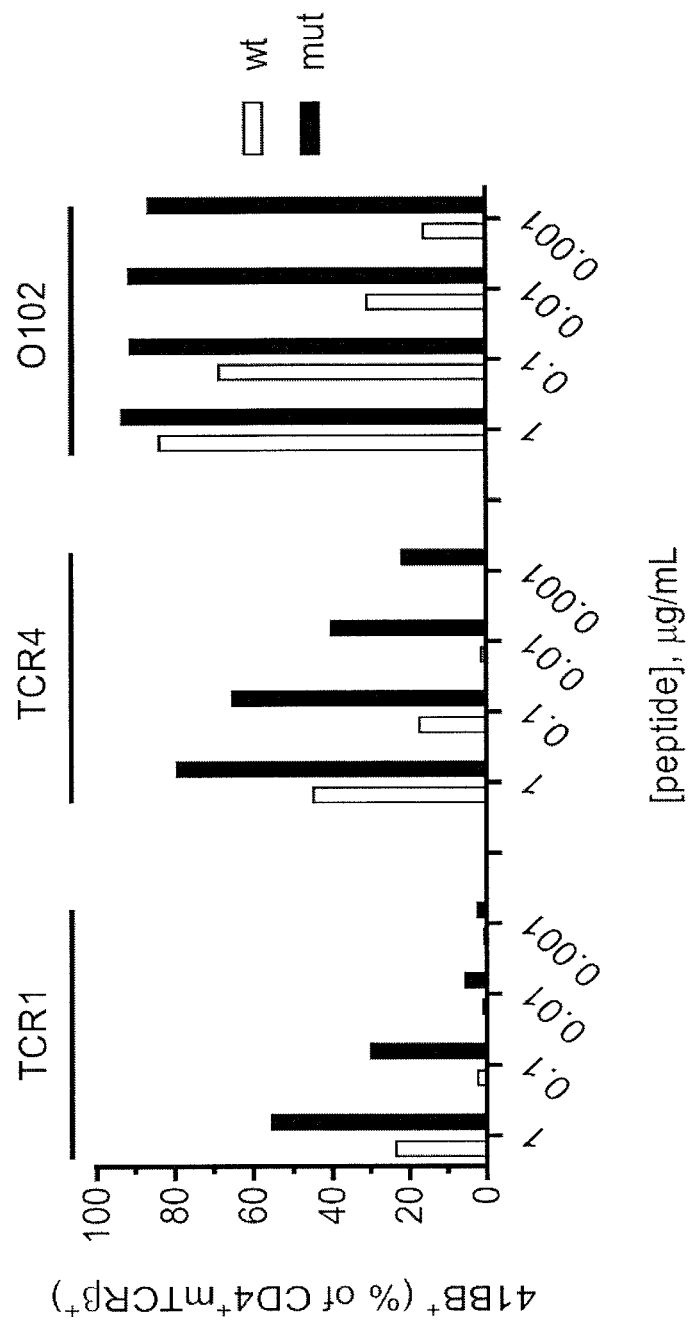
FIG. 2 is a graph showing the percentage of 4-1 BB positive cells (% of CD4+ mTCRβ+) detected following co-culture of autologous PBL transduced with one of the indicated TCRs from patient 4127 with autologous DCs pulsed with either WT p53-G245 peptide (wt) (unshaded bars) or mutated p53-G245S peptide (mut) (shaded bars) at the indicated decreasing peptide concentrations (μg/mL).
Figure 3:
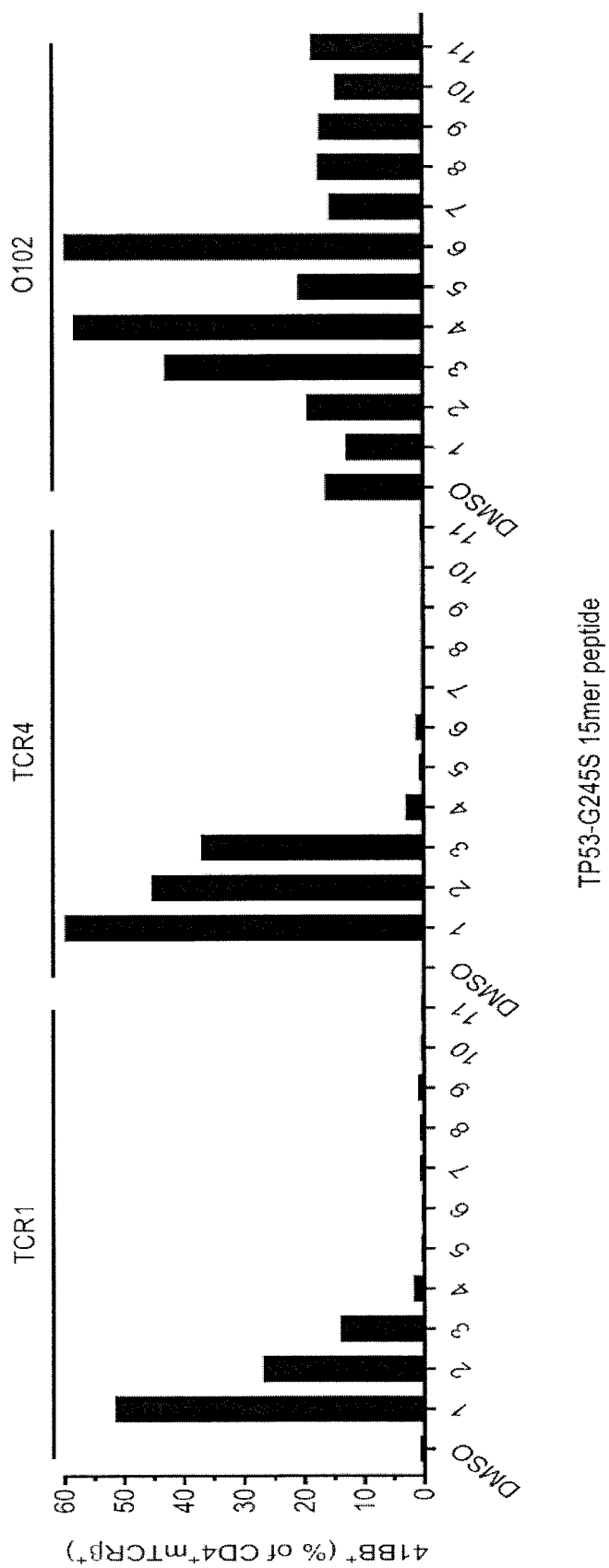
FIG. 3 is a graph showing the percentage of 4-1 BB positive cells (% of CD4+ mTCRβ+) detected following co-culture of autologous PBL transduced with one of the indicated TCRs from patient 4127 with autologous DCs pulsed with one of the peptides shown in Table A.

Autologous PBL were transduced with one of the TCRs shown in FIG. 3 and co-cultured as described for the experiment of FIG. 2 except that the DCs were pulsed with DMSO (peptide vehicle) or one of the 15-mer p53-G245S peptides with overlapping 14 amino acids shown in Table A. 4-1BB expression was carried out as described for FIG. 2. The results are shown in FIG. 3.

TABLE A

| Peptide no. in X-axis of Fig. 3 | Peptide | SEQ ID NO: |
|---|---|---|
| 1 | HYNYMCNSSCMGSMN | 497 |
| 2 | YNYMCNSSCMGSMNR | 498 |
| 3 | NYMCNSSCMGSMNRR | 499 |
| 4 | YMCNSSCMGSMNRRP | 500 |
| 5 | MCNSSCMGSMNRRPI | 501 |
| 6 | CNSSCMGSMNRRPIL | 502 |
| 7 | NSSCMGSMNRRPILT | 503 |
| 8 | SSCMGSMNRRPILTI | 504 |
| 9 | SCMGSMNRRPILTII | 505 |
| 10 | CMGSMNRRPILTIIT | 506 |
| 11 | MGSMNRRPILTIITL | 507 |

Cos 7 cells (2.5×10⁴ per well) were plated on wells of flat-bottom 96 well plates. After 20 hours, cells were co-transfected with individual HLA alleles. After 20 hours, cells were pulsed with p53G245S-15-mer peptide for 3 hours at 37° C. at 10 μg/mL. After washing, T cells (10⁵) were added to wells and co-cultured overnight (for 20 hours) at 37° C.

Figure 4:
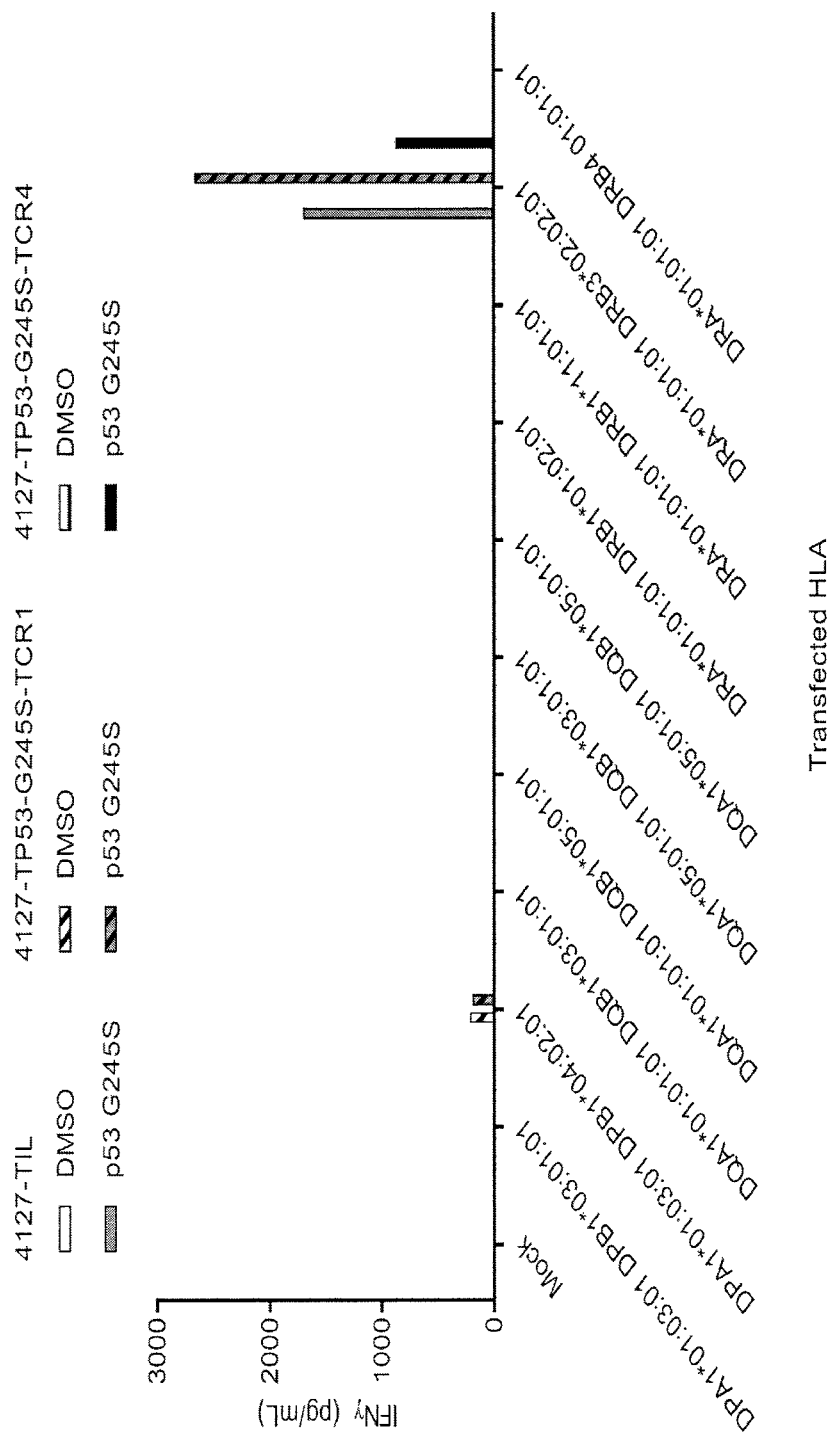
FIG. 4 is a graph showing the concentration of IFN-γ (pg/mL) measured following co-culture of TIL from patient 4127 or T cells transduced with one of the indicated TCRs with COS7 cells which were transduced with one of the indicated HLA alleles and pulsed with DMSO or one of the indicated peptides.
Figure 5:
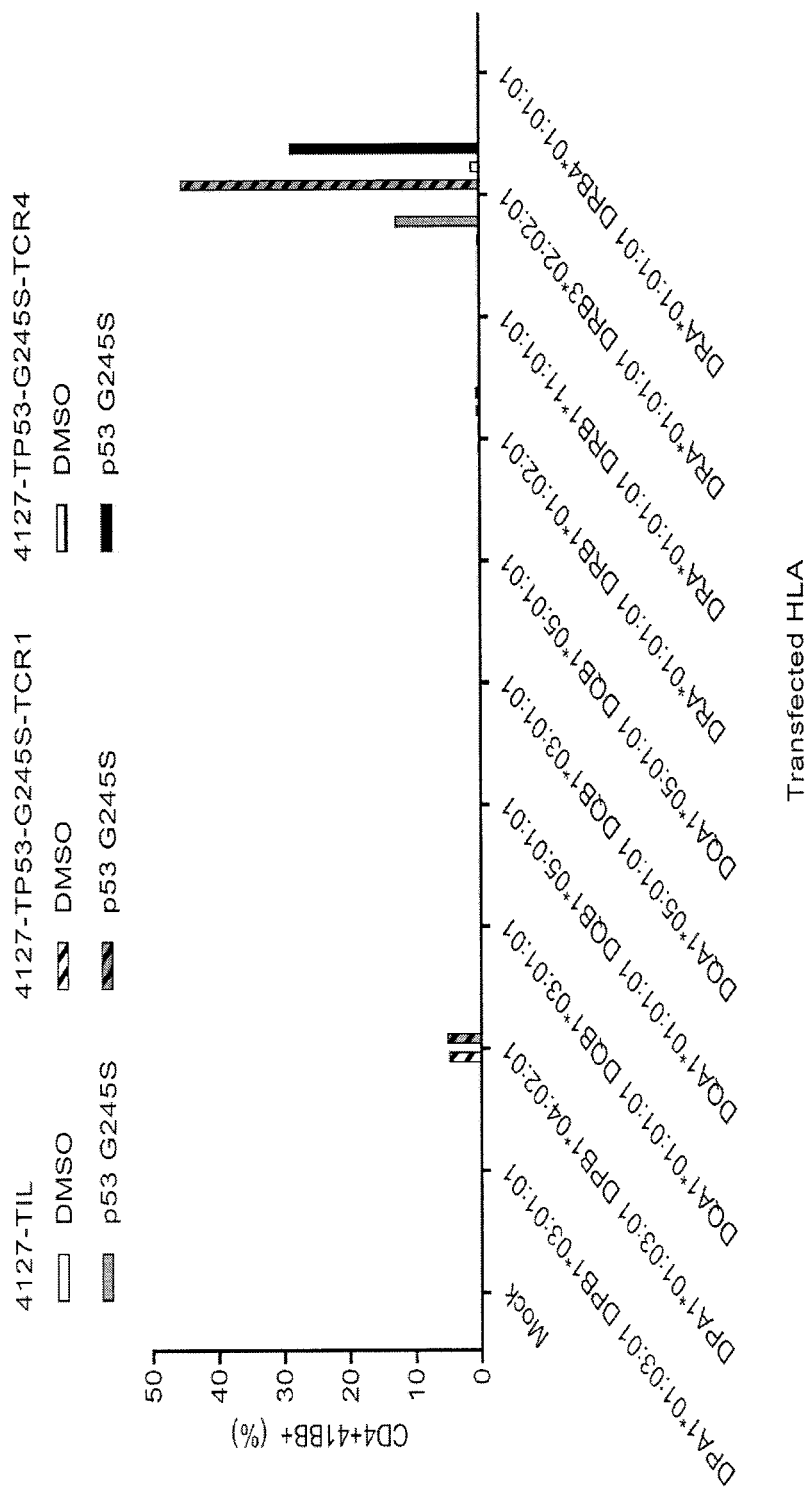
FIG. 5 is a graph showing the percentage of 4-1 BB positive cells (% of CD4+ mTCRβ+) detected following co-culture of TIL from patient 4127 or T cells which were transduced with one of the indicated TCRs with COS7 cells which were transduced with one of the indicated HLA alleles and pulsed with DMSO or one of the indicated peptides.

IFN-γ secretion was measured by ELISA; prediction by NetMHCIIpan: cbs.dtu.dk/services/NetMHCIIpan/. 4-1BB expression was measured by FACS. FACS gate: lymphocytes→live (PI negative)→CD3+ (T cells)→CD4+ (4127-TIL) or CD4+mTCR+ (TCR transduced T cells). The results are shown in FIGS. 4-5 and Table B.

TABLE B

| HLA | Peptide | Affinity, nM | Rank |
|---|---|---|---|
| DRB3*02:02 | HYNYMCNSSCMGSMN SEQ ID NO: 497 | 533.4 | 21 |

DRB3*02 is expressed by 1367 of 3719 (37%) of DRB-_typed patients in the NCI HLA database and 5 of 9 (56%) endometrial and ovarian cancer patients at NCI-SB (National Cancer Institute Surgery Branch). The reported frequency of the DRB3*02 allele is very high according to the allelefrequencies.net website. For example, this website reports that the frequency of the DRB3*02 allele is 0.3447 of the USA NMDP Middle Eastern or North Coast of Africa population.

TIL from patient 4127 were co-cultured with allogeneic (DRB3*01:01:01 or DRB3*02:02:01) antigen presenting cells (APCs) which were (1) electroporated with tandem minigenes (TMG) composed of irrelevant, WT p53, or mutated p53 sequence or (2) pulsed with peptide vehicle (DMSO) or purified (>95% by high-performance liquid chromatography (HPLC)) 25-amino acid peptides composed of WT p53-G245 sequence or mutated p53-G245S sequence. Co-cultures were performed overnight at 37° C. Secretion of IFN-γ was evaluated using ELISPOT assay. The results are shown in FIG. 6.

Figure 6:
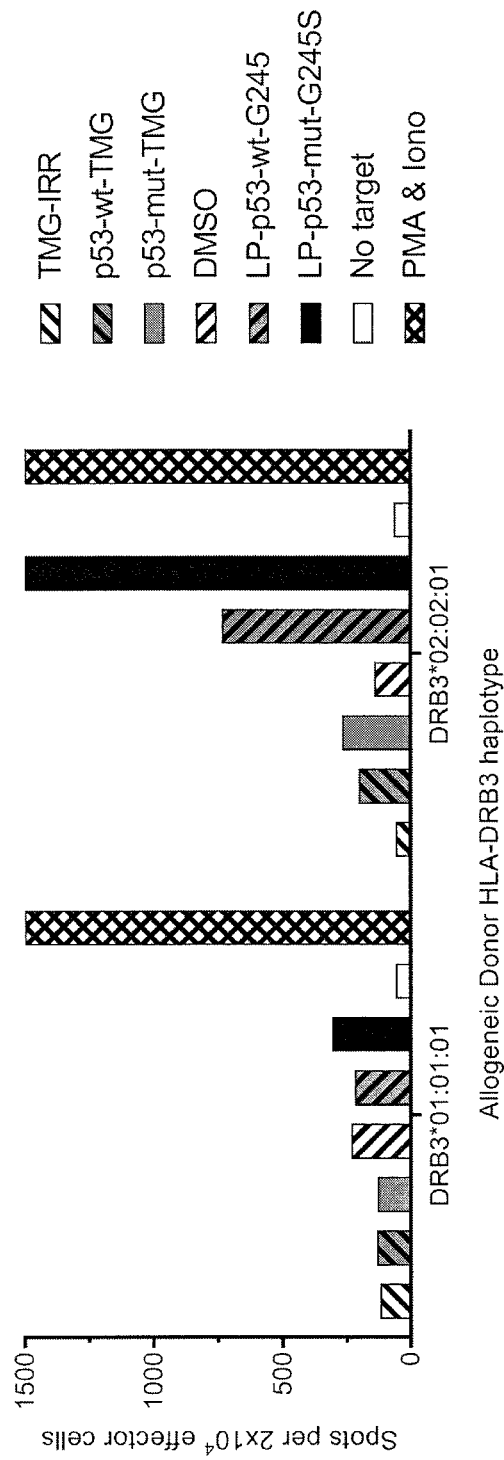
FIG. 6 is a graph showing the number of spots per $2 \times 10^4$ effector cells measured following co-culture of TIL from patient 4127 with allogeneic (DRB3*01:01:01 or DRB3*02:02:01) APCs which were (1) electroporated with TMG composed of irrelevant (IRR; left hatched open bars), WT p53 (p53-WT; left hatched gray bars) or mutated p53 (p53-MUT; gray bars) sequence or (2) pulsed with peptide vehicle (DMSO; right hatched open bars) or purified (>95% by HPLC) 25-amino acid peptides composed of WT p53-G245 sequence (LP-p53-wt-G245; right hatched gray bars) or mutated p53-G245S (LP-p53-mut-G245S; black bars) sequence.
Figure 7:
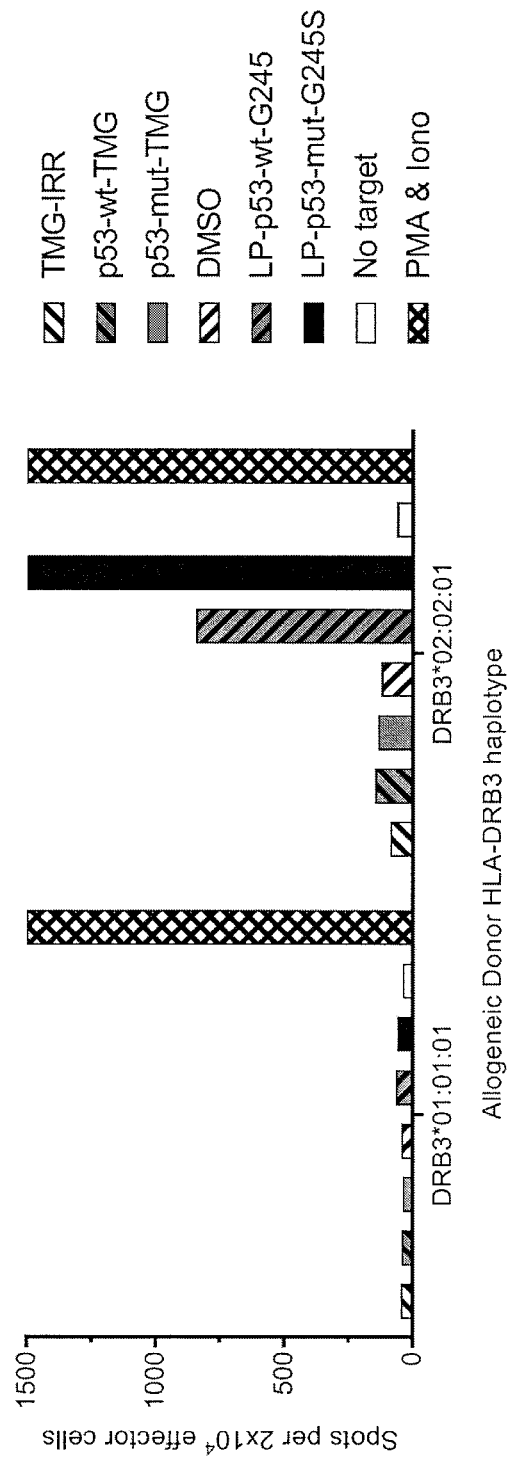
FIG. 7 is a graph showing the number of spots per $2 \times 10^4$ effector cells measured following co-culture of cells expressing the 4127-TCR1 with allogeneic (DRB3*01:01:01 or DRB3*02:02:01) APCs which were (1) electroporated with TMG composed of irrelevant (IRR; left hatched open bars), WT p53 (p53-WT; left hatched gray bars) or mutated p53 (p53-MUT; gray bars) sequence or (2) pulsed with peptide vehicle (DMSO; right hatched open bars) or purified (>95% by HPLC) 25-amino acid peptides composed of WT p53-G245 sequence (LP-p53-wt-G245; right hatched gray bars) or mutated p53-G245S (LP-p53-mut-G245S; black bars) sequence.

T cells expressing the 4127-TCR1 specific to p53-G245S were co-cultured with allogeneic APCs as described for the experiment of FIG. 6. The results are shown in FIG. 7.

Autologous APCs were pulsed with decreasing concentrations of 25-amino acid peptides corresponding to the WT p53-G245 or mutated p53-G245S sequence. T cells transduced with the 4127-O37-TCR from patient 4127 were co-cultured overnight at 37° C. with peptide-pulsed APCs. Expression of 4-1BB was assayed by flow cytometry after gating lymphocytes→single cells→live→CD3+mTCR+. The results are shown in FIG. 36.

Cos 7 cells ($2.5 \times 10^4$ per well) were plated on wells of flat-bottom 96 well plates. The following day, cells were co-transfected with individual HLA alleles from patient 4127. The next day, the 25-amino acid p53-G245S peptide was pulsed on transfected Cos 7 cells. Excess peptide was washed away. T cells were transduced with one of the TCRs from Patient 4127. The transduced T cells were added ($2 \times 10^4$ cells/well) to the co-culture with the Cos 7 cells. Co-cultures were incubated overnight at 37° C. Secretion of IFN-γ was evaluated by ELISA. Expression of 4-1BB was assayed by flow cytometry after gating lymphocytes→single cells→live→CD3+mTCR+. The results are shown in FIGS. 37A-37C.

The sequence of TCR 4127-TP53-G245S-TCR1, which was isolated from Patient 4127, is set forth below. Starting from the amino terminus, the first underlined region is the CDR1beta (SEQ ID NO: 30), the second underlined region is the CDR2beta (SEQ ID NO: 31), the third underlined region is the CDR3beta (SEQ ID NO: 32), the fourth underlined region is the CDR1alpha (SEQ ID NO: 27), the fifth underlined region is the CDR2alpha (SEQ ID NO: 28), and the sixth underlined region is the CDR3alpha (SEQ ID NO: 29). The bold region is the linker (SEQ ID NO: 26). Starting from the amino terminus, the first italicized region is the beta chain constant region (SEQ ID NO: 25) and the second italicized region is the alpha chain constant region (SEQ ID NO: 23). The beta chain variable region (SEQ ID NO: 34) includes the sequence starting from the amino terminus and ending immediately prior to the start of the beta chain constant region. The alpha chain variable region (SEQ ID NO: 33) includes the sequence starting immediately after the linker and ending immediately prior to the start of the alpha chain constant region. The full-length beta chain (SEQ ID NO: 36) includes the sequence starting from the amino terminus and ending immediately prior to the start of the linker. The full-length alpha chain (SEQ ID NO: 35) includes the sequence starting immediately after the linker and ending with the carboxyl terminus.

Cancer reactive T cells were identified as described below. The TCR was isolated as described below.

TCR name: 4127-TP53-G245S-TCR1
Recognition of p53 mutation: G245S
Method: Tran method
Co-culture to identify TCR: Co-culture 4127-F10 TIL fragment with G245S long peptide, sorted CD4+ 41BB+ T cells (single cell RT-PCR only)
Method to identify TCR: single-cell RT-PCR (below), Adaptive Pairseq (4127-F10 fragment), 5'RACE from TIL clone O71
Abundance of TCR amongst all paired TCRs: 31.3% (observed 5 times of 16 pairs)
TCR orientation: beta-alpha
Expression vector: gamma-retrovirus (SEQ ID NO: 543)
MATRLLCWAALCLLGAELTEAGVAQSPRYKIIEKRQSVAFWCNPI<u>SGHAT</u>

LYWYQQILGQGPKLLIQ<u>FQNNGV</u>VDDSQLPKDRFSAERLKGVDSTLKIQP

AKLEDSAVYL<u>CASSLVNTEAFF</u>GQGTRLTVV*EDLRNVTPPKVSLFEPSKA*

*EIANKQKATLVCLARGFFPDHVELSWWVNGKEVHSGVCTDPQAYKESNYS*

*YCLSSRLRVSATFWHNPRNHFRCQVQFHGLSEEDKWPEGSPKPVTQNISA*

*EAWGRADCGITSASYQQGVLSATILYEILLGKATLYAVLVSTLVVMAMVK*

*RKNS*RAKRSGSGATNFSLLKQAGDVEENPGPMLLLLIPVLGMIFALRDAR

AQSVSQHNHHVILSEAASLELGCNYS<u>YGGTVNL</u>FWYVQYPGQHLQLLLKY

<u>FSGDPLVK</u>GIKGFEAEFIKSKFSFNLRKPSVQWSDTAEYF<u>CAVKGDYKLS</u>

<u>FGA</u>GTTVTVRAN*IQNPEPAVYQLKDPRSQDSTLCLFTDFDSQINVPKTME*

*SGTFITDKCVLDMKAMDSKSNGAIAWSNQTSFTCQDIFKETNATYPSSDV*

*PCDATLTEKSFETDMNLNFQNLLVIVLRILLLKVAGENLLMILRLWSS*

The statistics for TCR 4127-TP53-G245S-TCR1 for Patient 4127 are set forth in Table 4 below.

TABLE 4

| Parameter | # | Frequency |
|---|---|---|
| Total wells | 96 | 100% |
| CDR3alpha | 6 | 6.3% |
| CDR3beta | 13 | 13.5% |
| 4127-TP53-G245S-TCR1 pairs | 5 | 5.2% |
| Total paired TCRs | 16 | 16.7% |

The sequence of TCR 4127-TP53-G245S-TCR4, which was isolated from Patient 4127, is set forth below. Starting from the amino terminus, the first underlined region is the CDR1beta (SEQ ID NO: 40), the second underlined region is the CDR2beta (SEQ ID NO: 41), the third underlined region is the CDR3beta (SEQ ID NO: 42), the fourth underlined region is the CDR1alpha (SEQ ID NO: 37), the fifth underlined region is the CDR2alpha (SEQ ID NO: 38), and the sixth underlined region is the CDR3alpha (SEQ ID NO: 39). The bold region is the linker (SEQ ID NO: 26). Starting from the amino terminus, the first italicized region is the beta chain constant region (SEQ ID NO: 25) and the second italicized region is the alpha chain constant region (SEQ ID NO: 23). The beta chain variable region (SEQ ID NO: 44) includes the sequence starting from the amino terminus and ending immediately prior to the start of the beta chain constant region. The alpha chain variable region (SEQ ID NO: 43) includes the sequence starting immediately after the linker and ending immediately prior to the start of the alpha chain constant region. The full-length beta chain (SEQ ID NO: 46) includes the sequence starting from the amino terminus and ending immediately prior to the start of the linker. The full-length alpha chain (SEQ ID NO: 45) includes the sequence starting immediately after the linker and ending with the carboxyl terminus.

Cancer reactive T cells were identified as described below. The TCR was isolated as described below.

TCR name: 4127-TP53-G245S-TCR4

Recognition of p53 mutation: G245S

Method: Tran method

Co-culture to identify TCR: Co-culture 4127-F10 TIL fragment with G245S long peptide, sorted CD4+ 41BB+ T cells (single cell RT-PCR only)

Method to identify TCR: single-cell RT-PCR (below) and Adaptive Pairseq (4127-F10 fragment)

Abundance of TCR amongst all paired TCRs: 12.5% (observed 2 times of 16 pairs)

TCR orientation: beta-alpha

Expression vector: gamma-retrovirus (SEQ ID NO: 544)
MAPGLLEIWMALCLLGTGHGDAMVIQNPRYQVTQFGKPVTLSCSQT<u>LNHN</u>
<u>VMYWYQQKSSQAPKLLFHYYDKDF</u>NNEADTPDNFQSRRPNTSFCFLDIRS
PGLGDAAMYL<u>CATSRELRGNEQFFGPGTRLTV</u>*EDLRNVTPPKVSLFEPS
KAEIANKQKATLVCLARGFFPDHVELSWWVNGKEVHSGVCTDPQAYKESN
YSYCLSSRLRVSATFWHNPRNHFRCQVQFHGLSEEDKWPEGSPKPVTQNI
SAEAWGRADCGITSASYQQGVLSATILYEILLGKATLYAVLVSTLVVMAM
VKRKNS*RAKRSGSGATNESLLKQAGDVEENPGP*MLTASLLRAVIASICVV
SSMAQKVTQAQTEISVVEKEDVTLDCVYE<u>TRDTTYY</u>LFWYKQPPSGELVF
LIRR<u>NSFDEQN</u>EISGRYSWNFQKSTSSFNFTITASQVVDSAVYF<u>CALSEG</u>
<u>GSNYKLTFGKGTLLTVNPN</u>IQNPEPAVYQLKDPRSQDSTLCLFTDEDSQI
NVPKTMESGTFITDKCVLDMKAMDSKSNGAIAWSNQTSETCQDIFKEINA
TYPSSDVPCDATLTEKSFETDMNLNFQNLLVIVLRILLLKVAGENLLMTL
RLWSS*

The statistics for TCR 4127-TP53-G245S-TCR4 for Patient 4127 are set forth in Table 5 below.

TABLE 5

| Parameter | # | Frequency |
|---|---|---|
| Total wells | 96 | 100% |
| CDR3alpha | 2 | 2.1% |
| CDR3beta | 39 | 40.6% |
| 4127-TP53-G245S-TCR4 pairs | 2 | 2.1% |
| Total paired TCRs | 16 | 16.7% |

The sequence of TCR 4127_O102_TCR, which was isolated from Patient 4127, is set forth below. Starting from the amino terminus, the first underlined region is the CDR1beta (SEQ ID NO: 50), the second underlined region is the CDR2beta (SEQ ID NO: 51), the third underlined region is the CDR3beta (SEQ ID NO: 52), the fourth underlined region is the CDR1alpha (SEQ ID NO: 47), the fifth underlined region is the CDR2alpha (SEQ ID NO: 48), and the sixth underlined region is the CDR3alpha (SEQ ID NO: 49). The bold region is the linker (SEQ ID NO: 26). Starting from the amino terminus, the first italicized region is the beta chain constant region (SEQ ID NO: 25) and the second italicized region is the alpha chain constant region (SEQ ID NO: 23). The beta chain variable region (SEQ ID NO: 54) includes the sequence starting from the amino terminus and ending immediately prior to the start of the beta chain constant region. The alpha chain variable region (SEQ ID NO: 53) includes the sequence starting immediately after the linker and ending immediately prior to the start of the alpha chain constant region. The full-length beta chain (SEQ ID NO: 56) includes the sequence starting from the amino terminus and ending immediately prior to the start of the linker. The full-length alpha chain (SEQ ID NO: 55) includes the sequence starting immediately after the linker and ending with the carboxyl terminus.

Cancer reactive T cells were identified as described below. The TCR was isolated as described below.

TCR name: 4127_O102_TCR

Recognition of p53 mutation: G245S

Method: Tran method

Co-culture to identify TCR: Not performed. TCR was directly identified from RNA of T cell clone (O102) using 5'RACE. Clone was developed by sorting for OX40+ T cells and establishing T cell clones by limiting dilution. T cell clones were screened using the Tran method.

Method to identify TCR: 5'RACE from TIL clone O102

Abundance of TCR amongst all paired TCRs: 100% of T cell clone (not applicable)

TCR orientation: beta-alpha

Expression vector: gamma-retrovirus (SEQ ID NO: 545)
MAMSIGLLCCAALSLLWAGPVNAGVTQTPKFQVLKTGQSMTLQCAQD<u>MNH</u>
<u>EYMSWYRQDPGMGLRLIHYSVGAGI</u>TDQGEVPNGYNVSRSTTEDFPLRLL
SAAPSQTSVYF<u>CASSYRESHYGYTFGSGTRLTVV</u>*EDLRNVTPPKVSLFEP
SKAEIANKQKATLVCLARGFFPDHVELSWWVNGKEVHSGVCTDPQAYKES
NYSYCLSSRLRVSATFWHNPRNHFRCQVQFHGLSEEDKWPEGSPKPVTQN
ISAEAWGRADCGITSASYQQGVLSATILYEILLGKATLYAVLVSTLVVMA
MVKRKNS*RAKRSGSGATNFSLLKQAGDVEENPGP*MWGVFLLYVSMKMGGT
TGQNIDQPTEMTATEGAIVQINCTYQ<u>TSGFN</u>GLFWYQQHAGEAPTFLSY<u>N</u>

-continued

VLDGLEEKGRFSSFLSRSKGYSYLLLKELQMKDSASYL<u>CAVKWTGGFKTI</u>

<i>FGAGTRLFVKANIQNPEPAVYQLKDPRSQDSTLCLFTDFDSQINVPKTME</i>

<i>SGTFITDKCVLDMKAMDSKSNGAIAWSNQTSFTCQDIFKETNATYPSSDV</i>

<i>PCDATLTEKSFETDMNLNFQNLLVIVLRILLLKVAGFNLLMTLRLWSS</i>

The sequence of TCR 4127-O37-TCR, which was isolated from Patient 4127, is set forth below. Starting from the amino terminus, the first underlined region is the CDR1beta (SEQ ID NO: 460), the second underlined region is the CDR2beta (SEQ ID NO: 461), the third underlined region is the CDR3beta (SEQ ID NO: 462), the fourth underlined region is the CDR1alpha (SEQ ID NO: 457), the fifth underlined region is the CDR2alpha (SEQ ID NO: 458), and the sixth underlined region is the CDR3alpha (SEQ ID NO: 459).

The bold region is the linker (SEQ ID NO: 26). Starting from the amino terminus, the first italicized region is the beta chain constant region (SEQ ID NO: 25) and the second italicized region is the alpha chain constant region (SEQ ID NO: 23). The beta chain variable region (SEQ ID NO: 464) includes the sequence starting from the amino terminus and ending immediately prior to the start of the beta chain constant region. The alpha chain variable region (SEQ ID NO: 463) includes the sequence starting immediately after the linker and ending immediately prior to the start of the alpha chain constant region. The full-length beta chain (SEQ ID NO: 466) includes the sequence starting from the amino terminus and ending immediately prior to the start of the linker. The full-length alpha chain (SEQ ID NO: 465) includes the sequence starting immediately after the linker and ending with the carboxyl terminus.

Cancer reactive T cells were identified as described below. The TCR was isolated as described below.

TCR name: 4127-O37-TCR
Recognition of p53 mutation: G245S
Method: Tran method
Co-culture to identify TCR: Not performed. TCR was directly identified from genomic DNA of T cell clone (O37) using Adaptive TCRAD and TCRB surveys (next-generation sequencing (NGS) platform). The O37 clone was developed by sorting for OX40+ T cells and establishing T cell clones by limiting dilution. T cell clones were screened using the Tran method.
Method to identify TCR: Adaptive TCR sequencing (NGS) of TIL clone O37
Abundance of TCR amongst all paired TCRs: 100% of T cell clone (n/a)
TCR orientation: beta-alpha
Expression vector: gamma-retrovirus (SEQ ID NO: 546)
MALLULLGPGISLLLPGSLAGSGLGAVVSQHPSWVICKSGTSVKIECRSL DF<u>QATTMFWYRQFPKQSLMLMAT</u>SNEGSKATYEQGVEKDKFLINHASLTL STLTVTSAHPEDSSFYI<u>CSAAGQANTEAFF</u>GQGTRLTVV<i>EDLRNVTPPKV</i>

<i>SLFEPSKAEIANKQKATLVCLARGFFPDHVELSWWVNGKEVHSGVCTDPQ</i>

<i>AYKESNYSYCLSSRLRVSATFWHNPRNHFRCQVQFHGLSEEDKWPEGSPK</i>

<i>PVTQNISAEAWGRADCGITSASYQQGVLSATILYEILLGKATLYAVLVST</i>

<i>LVVMAMVKRKNS</i>RAKRSGSGATNFSLLKQAGDVEENPGPMHSLRVLLVIL

-continued

WLQLSWVWSQQKEVEQNSGPLSVPEGAIASLNCTYS<u>DRGSQSFFWYRQYS</u>

GKSPELIMF<u>IYSNGD</u>KEDGRFTAQLNKASQYVSLLIRDSQPSDSATYLC<u>A</u>

<u>VNDAGNMLTF</u>GGGTRLMVKP<i>NIQNPEPAVYQLKDPRSQDSTLCLFTDFDS</i>

<i>QINVPKTMESGTFITDKCVLDMKAMDSKSNGAMWSNQTSFTCQDIFKETN</i>

<i>ATYPSSDVPCDATLTEKSFEIDMNLNFQNLLVIVLRILLLKVAGFNLLMT</i>

<i>LRLWSS</i>

Example 2

This example demonstrates the isolation and specific reactivity of three anti-mutated p53 TCRs from patient 4196.

Experiments were carried out as described for FIGS. 8-11 for Patient 4196. The p53 reactive T cells for this patient were identified by the Tran method, as described in U.S. Patent Application Number 2017/0224800. The Fluidigm method was used for isolating the individual TCRs. The statistics for Patient 4196 are shown in Table D.

Characterization of p53-reactive cells: challenges with identifying the minimal epitope: The first predicted peptide with mutated amino acid p53 R175H is shown in Table C.

TABLE C

| HLA | HLA-A0201 |
|---|---|
| Peptide | HMTEVVRHC (SEQ ID NO: 530) |
| Core | HMTEVVRHC (SEQ ID NO: 530) |
| Affinity (nM) | 7826.06 |
| % rank | 13.00 |

Figure 8B:
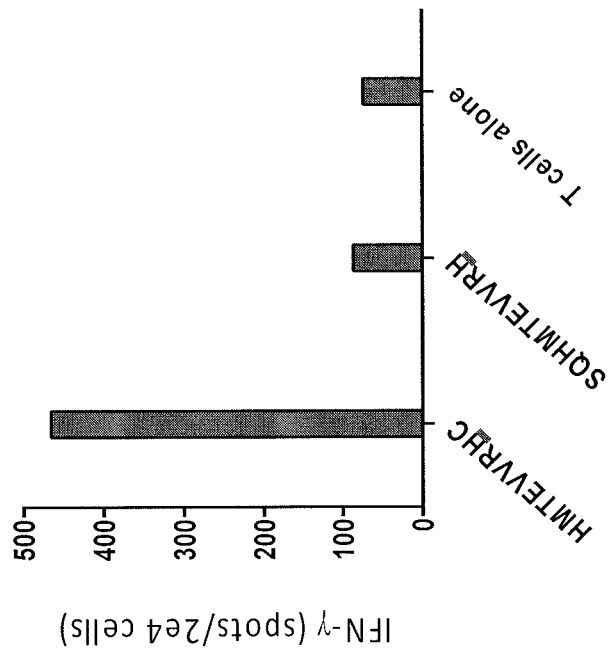
FIG. 8B is a graph showing IFN-γ secretion (spots/$2 \times 10^4$ cells) measured following co-culture of TIL from the infusion bag used to treat patient 4196 with autologous DCs pulsed with candidate minimal epitope (HMTEVVRHC (SEQ ID NO: 530) or (SQHMTEVVRH (SEQ ID NO: 531)). T cells cultured alone served as a control.
Figure 8A:
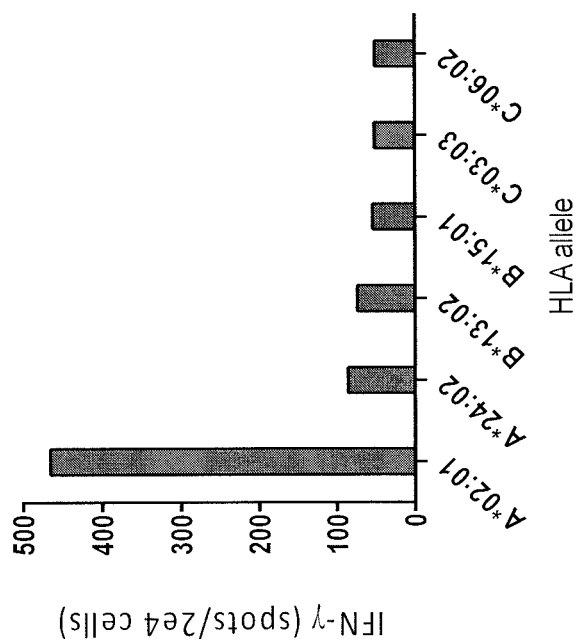
FIG. 8A is a graph showing IFN-γ secretion (spots/$2 \times 10^4$ cells) measured following co-culture of TIL from the infusion bag used to treat patient 4196 with Cos 7 cells transfected with plasmids for TMG1 and the indicated HLA allele.

TMG1 versus 4196-Rx1 TIL: Cos 7 cells were transfected with plasmids for TMG1 and HLA allele. Cells were co-cultured with 4196 Rx1 TIL infusion bag for 20 hours (h). The results are shown in FIG. 8A.

P53-R175H minimal peptide versus 4196-Rx1 TIL: Day 4 autologous DCs were pulsed with either candidate minimal epitope (HMTEVVRHC (SEQ ID NO: 530) or (SQHMTEVVRH (SEQ ID NO: 531)) for 2 h. Cells were washed and co-cultured with 4196 Rx1 TIL infusion bag for 20 h. The results are shown in FIG. 8B.

A*02:01-restricted TP53 tetramer can be used to isolate TP53-reactive cells from the TIL infusion bag: Isolation of TP53-reactive cells using 4-1BB+ sort following co-culture with TP53 peptide was technically limited. To isolate TP53-reactive cells, an A*02:01-TP53 tetramer was generated. An irrelevant tetramer (A*02:01-gp100) was generated as a control. A FACS analysis was carried out gated on live, CD3+, CD8+ cells. For the A*02:01-TP53 tetramer, 14.9% p53 tetramer+ cells were detected. For the A*02:01-gp100 tetramer, 0.7% p53 tetramer+ cells were detected.

Isolation and characterization of TP53-reactive cells: The strategy for the isolation and characterization of TP53-reactive cells was as follows: (1) sort for tetramer-positive cells using FACS as described above. (2) Carry out single cell PCR. (3) Carry out Vβ seep sequencing.

Several candidate clones were identified for the TP53 TCR using single cell PCR, as shown in Table D. TCR-1a and TCR-1b were alternative candidate clones.

TABLE D

| | | Candidate TCR CDR3 (amino acids) | |
|---|---|---|---|
| TCR-1a | TRBV6-1 | CASSEGLWQVGDEQYF (SEQ ID NO: 72) | 63.3% of 120 pairs |
| | TRAV12-1 | CVVQPGGYQKVTF (SEQ ID NO: 69) | |
| TCR-1b | TRBV6-1 | Not functional | |
| | TRAV2 | | |
| TCR-2 | TRBV11-2 | CASSLDPGDTGELFF (SEQ ID NO: 92) | 25.8% of 120 pairs |
| | TRAV6 | CALDIYPHDMRF (SEQ ID NO: 89) | |
| TCR-3 | TRBV10-3 | CAISELVTGDSPLHF (SEQ ID NO: 82) | 9.2% of 120 pairs |
| | TRAV38-1 | CAFMGYSGAGSYQLTF (SEQ ID NO: 79) | |

Plasmids encoding candidate TCRs were cloned with MSGV1 vectors. Retroviral transduction was used to introduce TCR into donor lymphocytes.

HPLC grade minimal epitope was pulsed on day 4 on A*02:01 DCs for 2 h. DCs were co-cultured with TCR-transduced cells for 20 h. The results are shown in FIGS. 9A-9D. Three different A*02:01 restricted TP53 receptors were identified.

Figure 10A:
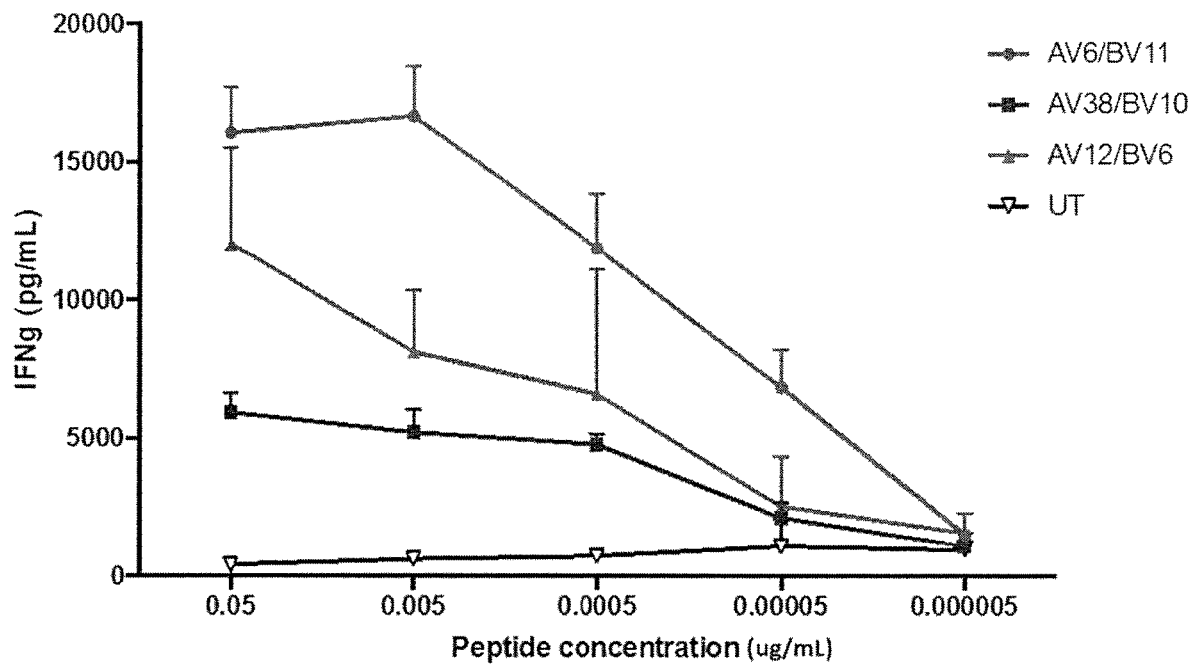
FIGS. 10A-10B are graphs showing IFN-γ secretion (pg/mL) (A) and percentage of 4-1BB positive cells (%, mTCRβ+) (B) measured following co-culture of T2 cells pulsed with the minimal mutated epitope at the indicated concentrations with cells transduced with one of the following TCRs: AV12/BV6-1 (closed triangles), AV6/BV11 (circles), or AV38/BV10-3 (squares). Co-culture of pulsed T2 cells with untransduced (UT) cells (open triangles) served as a control.
Figure 10B:
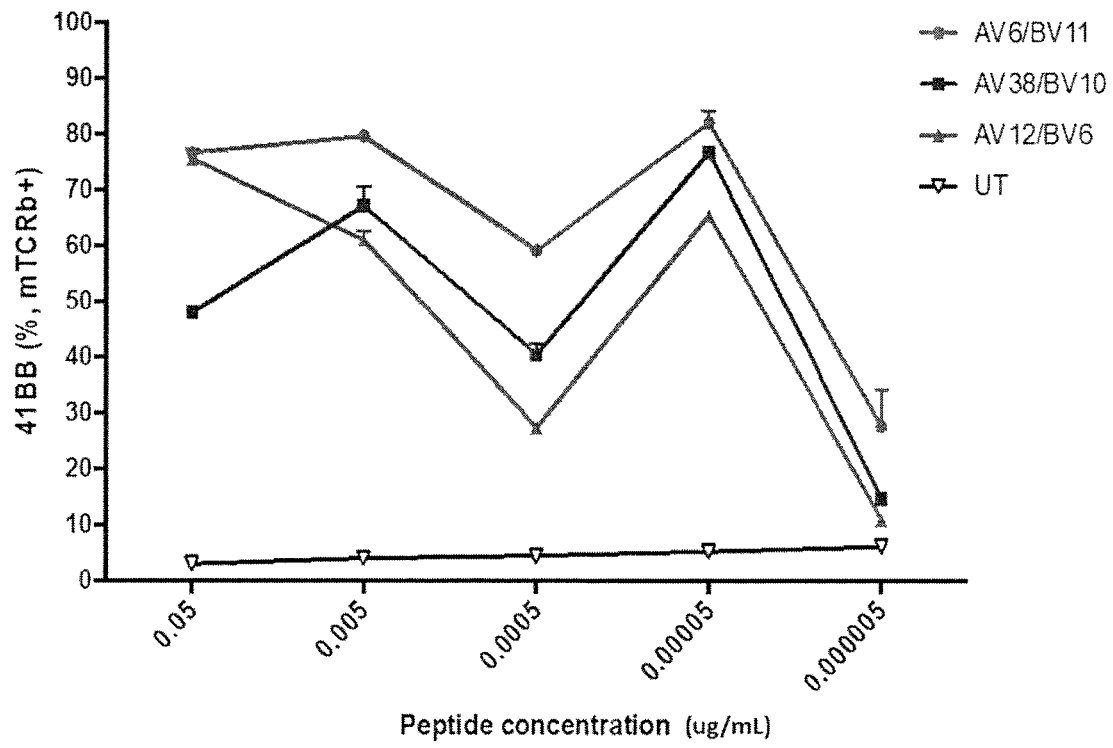

T2 cells were thawed and rested for 24 hours, then pulsed with decreasing concentrations of HPLC minimal epitope for 2 h. Cells were then washed and co-cultured with TP53 TCR-transduced cells for 17 h. The results are shown in FIGS. 10A-10B.

The following parental tumor cell lines were transduced with HLA-A*02:01: Colon line—LS123 (ATCC CCL-255) with R175H but unknown HLA-A2 status. Leukemia line: CCRF-CEM (ATCC CRM-CCL-119, leukemia) with R175H but unknown HLA-A2 status. Breast line: AU-565 (ATCC CRL-2351, breast adenocarcinoma) with R175H but unknown HLA-A2 status. Melanoma cell line: MEL624; endogenous expression of HLA-A2 and wt R175.

Figure 11:
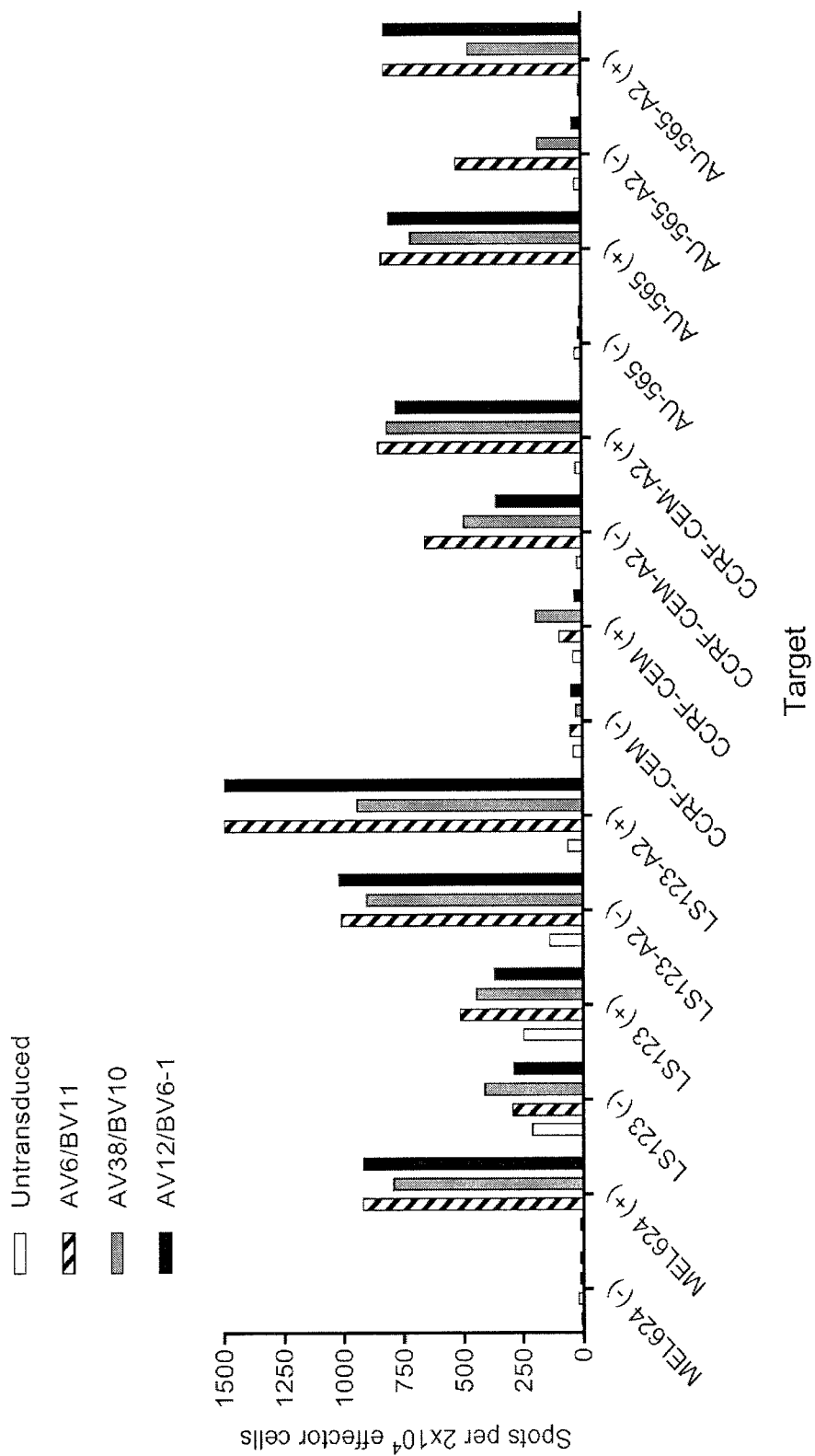
FIG. 11 is a graph showing the number of IFN-γ-positive spots per $2 \times 10^4$ effector cells detected following co-culture of TCR-transduced cells with the indicated target cell lines. Effector cells were transduced with AV12/BV6-1 (black bars), AV6/BV11 (striped bars), or AV38/BV10-3 (grey bars). HLA-A*02:01-transduced target cells are indicated by LS123-A2, CCRF-CEM-A2 and AU-565-A2. Peptide-pulsed target cells are indicated by (+). Target cells not pulsed with peptide are indicated by (−). Untransduced effector cells (unshaded bars) co-cultured with target cell lines were used as a control.

Target transduced tumor cells were harvested and plated on the morning of co-culture (1×10⁵ cells/well). R175H minimal epitope was pulsed onto target cells (HPLC, 5 µg/mL) for 2 h. Cells were washed twice and co-cultured with 2×10⁴ TP53 TCR-transduced cells for 20 h (patient 4196). IFN-γ ELISPOT was used for the readout of response. The results are shown in FIG. 11. Additional experimental data regarding target cell HLA-A2 and TP53 expression and the reactivity of the TCRs of this Example is provided in Example 15.

The sequence of TCR 4196_AV12-1_with_BV6-1, which was isolated from Patient 4196, is set forth below. Starting from the amino terminus, the first underlined region is the CDR1beta (SEQ ID NO: 70), the second underlined region is the CDR2beta (SEQ ID NO: 71), the third underlined region is the CDR3beta (SEQ ID NO: 72), the fourth underlined region is the CDR1alpha (SEQ ID NO: 67), the fifth underlined region is the CDR2alpha (SEQ ID NO: 68), and the sixth underlined region is the CDR3alpha (SEQ ID NO: 69). The bold region is the linker (SEQ ID NO: 26). Starting from the amino terminus, the first italicized region is the beta chain constant region (SEQ ID NO: 25) and the second italicized region is the alpha chain constant region (SEQ ID NO: 24). The beta chain variable region (SEQ ID NO: 74) includes the sequence starting from the amino terminus and ending immediately prior to the start of the beta chain constant region. The alpha chain variable region (SEQ ID NO: 73) includes the sequence starting immediately after the linker and ending immediately prior to the start of the alpha chain constant region. The full-length beta chain (SEQ ID NO: 76) includes the sequence starting from the amino terminus and ending immediately prior to the start of the linker. The full-length alpha chain (SEQ ID NO: 75) includes the sequence starting immediately after the linker and ending with the carboxyl terminus.

Cancer reactive T cells were identified as described below.

TCR name: 4196_AV12-1_with_BV6-1
Recognition of p53 mutation: R175H
Method: Tran method (SEQ ID NO: 547)
MAIGLLCCVAFSLLWASPVNAGVTQTPKFQVLKTGQSMTLQCAQDMNHNS

MYWYRQDPGMGLRLIYYSASEGTTDKGEVPNGYNVSRLNKREFSLRLESA

APSQTSVYFCASSEGLWQVGDEQYFGPGTRLTVT*EDLRNVTPPKVSLFEP*

*SKAEIANKQKATLVCLARGFFPDHVELSWWVNGKEVHSGVCTDPQAYKES*

*NYSYCLSSRLRVSATFWHNPRNHFRCQVQFHGLSEEDKWPEGSPKPVTQN*

*ISAEAWGRADCGITSASYQQGVLSATILYEILLGKATLYAVLVSTLVVMA*

*MVKRKNS*RAKRSGSGATNFSLLKQAGDVEENPGPMISLRVLLVILWLQLS

WVWSQRKEVEQDPGPFNVPEGATVAFNCTYSNSASQSFEWYRQDCRKEPK

LLMSVYSSGNEDGRFTAQLNRASQYISLLIRDSKLSDSATYLCVVQPGGY

QKVTFGTGTKLQVIP*DIQNPEPAVYQLKDPRSQDSTLCIFTDFDSQINVP*

*KTMESGTFITDKCVLDMKAMDSKSNGAMWSNQTSFTCQDIFKETNATYPS*

*SDVPCDATLTEKSFETDMNLNFQNLLVIVLRILLLKVAGENLLMTLRLWS*

*S*

The sequence of TCR 4196_AV38-1_with_BV10-3, which was isolated from Patient 4196, is set forth below. Starting from the amino terminus, the first underlined region is the CDR1beta (SEQ ID NO: 80), the second underlined region is the CDR2beta (SEQ ID NO: 81), the third underlined region is the CDR3beta (SEQ ID NO: 82), the fourth underlined region is the CDR1alpha (SEQ ID NO: 77), the fifth underlined region is the CDR2alpha (SEQ ID NO: 78), and the sixth underlined region is the CDR3alpha (SEQ ID NO: 79). The bold region is the linker (SEQ ID NO: 26). Starting from the amino terminus, the first italicized region is the beta chain constant region (SEQ ID NO: 25) and the second italicized region is the alpha chain constant region (SEQ ID NO: 24). The beta chain variable region (SEQ ID NO: 84) includes the sequence starting from the amino terminus and ending immediately prior to the start of the beta chain constant region. The alpha chain variable region (SEQ ID NO: 83) includes the sequence starting immediately after the linker and ending immediately prior to the start of the alpha chain constant region. The full-length beta chain (SEQ ID NO: 86) includes the sequence starting from the amino terminus and ending immediately prior to the start of the linker. The full-length alpha chain (SEQ ID NO: 85) includes the sequence starting immediately after the linker and ending with the carboxyl terminus.

Cancer reactive T cells were identified as described below.

TCR name: 4196 AV38-1_with_BV10-3
Recognition of p53 mutation: R175H
Method: Tran method (SEQ ID NO: 548)
MATRLFFYVALCLLWTGHMDAGITQSPRHKVTETGTPVTLRCHQT<u>ENHRYM</u>
YWYRQDPGHGLRLIHY<u>SYGVKD</u>TDKGEVSDGYSVSRSKTEDFLLTLESATS
SQTSVYF<u>CAISELVTGDSPLHF</u>GNGTRLTVT*EDLRNVTPPKVSLFEPSKAE*
*IANKQKATLVCLARGFFPDHVELSWWVNGKEVHSGVCTDPQAYKESNYSYC*
*LSSRLRVSATFWHNPRNHTRCQVQFFIGLSEEDKWPEGSPKPVTQNISAEA*
*WGRADCGITSASYQQGVLSATILYEILLGKATLYAVLVSTLVVMAMVKRKN*
SRAKRSGSGATNFSLLKQAGDVEENPGPMTRVSLLWAVVVSTCLESGMAQT
VTQSQPEMSVQEAETVTLSCTYDT<u>SENNYY</u>LFWYKQPPSRQMILVIR<u>QEAY</u>
<u>KQQN</u>ATENRFSVNFQKAAKSFSLKISDSQLGDTAMYF<u>CAFMGYSGAGSYQL</u>
<u>TF</u>GKGTKLSVIP*DIQNPEPAVYQLKDPRSQDSTLCLFTDFDSQINVPKTME*
*SGTFITDKCVLDMKAMDSKSNGAMWSNQTSFTCQDIFKETNATYPSSDVPC*
*DATLEKSFETDMNLNFQNLLVIVLRILLLKVAGFNLLMTLRLWSS*

The sequence of TCR 4196_AV6_with_BV11-2, which was isolated from Patient 4196, is set forth below. Starting from the amino terminus, the first underlined region is the CDR1beta (SEQ ID NO: 90), the second underlined region is the CDR2beta (SEQ ID NO: 91), the third underlined region is the CDR3beta (SEQ ID NO: 92), the fourth underlined region is the CDR1alpha (SEQ ID NO: 87), the fifth underlined region is the CDR2alpha (SEQ ID NO: 88), and the sixth underlined region is the CDR3alpha (SEQ ID NO: 89). The bold region is the linker (SEQ ID NO: 26). Starting from the amino terminus, the first italicized region is the beta chain constant region (SEQ ID NO: 25) and the second italicized region is the alpha chain constant region (SEQ ID NO: 24). The beta chain variable region (SEQ ID NO: 94) includes the sequence starting from the amino terminus and ending immediately prior to the start of the beta chain constant region. The alpha chain variable region (SEQ ID NO: 93) includes the sequence starting immediately after the linker and ending immediately prior to the start of the alpha chain constant region. The full-length beta chain (SEQ ID NO: 96) includes the sequence starting from the amino terminus and ending immediately prior to the start of the linker. The full-length alpha chain (SEQ ID NO: 95) includes the sequence starting immediately after the linker and ending with the carboxyl terminus.

Cancer reactive T cells were identified as described below.
TCR name: 4196_AV6_with_BV11-2
Recognition of p53 mutation: R175H
Method: Tran method (SEQ ID NO: 549)
MATRLLCWAALCLLGAELTEAGVAQSPRYKIIEKRQSVAFWCNPI<u>SGHAT</u>
<u>LY</u>WYQQILGQGPKLLIQ<u>FQNNG</u>VVDDSQLPKDRFSAERLKGVDSTLKIQP
AKLEDSAVYL<u>CASSLDPGDTGELFF</u>GEGSRLTVL*EDLRNVTPPKVSLFEP*
*SKAEIANKQKATLVCLARGFFPDHVELSWWVNGKEVHSGVCTDPQAYKES*
*NYSYCLSSRLRVSATFWHNPRNHFRCQVQFHGLSEEDKWPEGSPKPVTQN*
*ISAEAWGRADCGITSASYQQGVLSATILYEILLGKATLYAVLVSTLVVMA*
*MVKRKN*SRAKRSGSGATNFSLLKQAGDYEENPGPMESFLGGVLLILWLQV
DWVKSQKIEQNSEALNIQEGKTATLTCNYT<u>NYSPAYL</u>QWYRQDPGRGPVF LLLI<u>RENEKEKRK</u>ERLKVTFDTTLKQSLFHITASQPADSATYL<u>CALDIYP</u>
<u>HDMRF</u>GAGTRLTVKP*DIQNPEPAVYQLKDPRSQDSTLCLFTDFDSQINVP*
*KTMESGTFITDKCVLDMKAMDSKSNGAMWSNQTSFTCQDIFKETNATYPS*
*SDVPCDATLTEKSFETDMNLNFQNLLVIVLRILLLKVAGFNLLMTLRLWS*
*S*

Example 3

This example demonstrates the isolation of eleven anti-mutated p53 TCRs from patient 4238.

Experiments were carried out as described for FIGS. 12-15 for Patient 4238.

Figure 12:
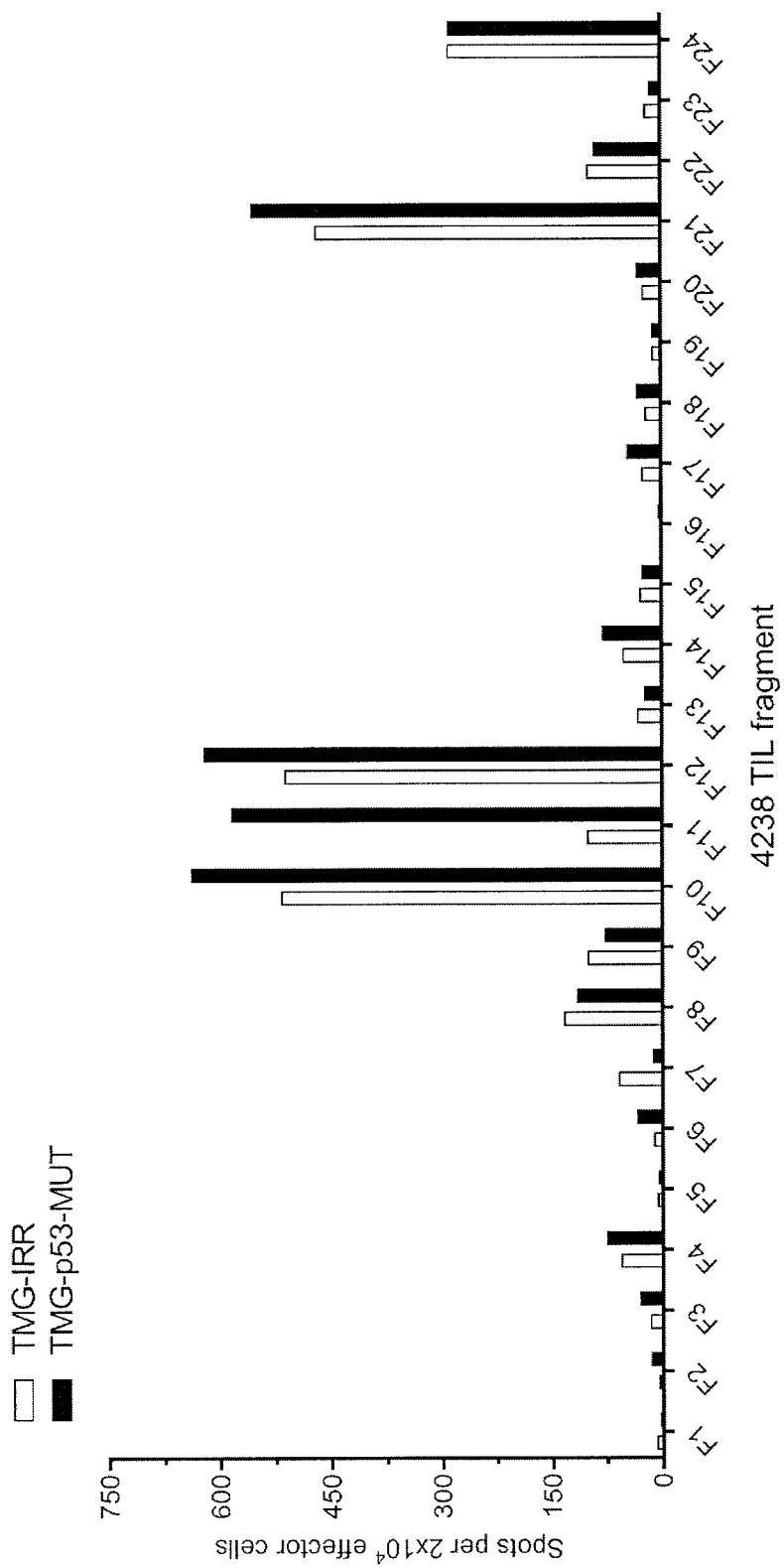
FIG. 12 is a graph showing the number of IFN-γ-positive spots per $2 \times 10^4$ effector cells measured following co-culture of Patient 4238 TIL fragments F1-F24 (n=24) with autologous APCs electroporated with TMG composed of irrelevant (IRR; open bars) or mutated p53 (p53-MUT; black bars) sequence.
Figure 14:
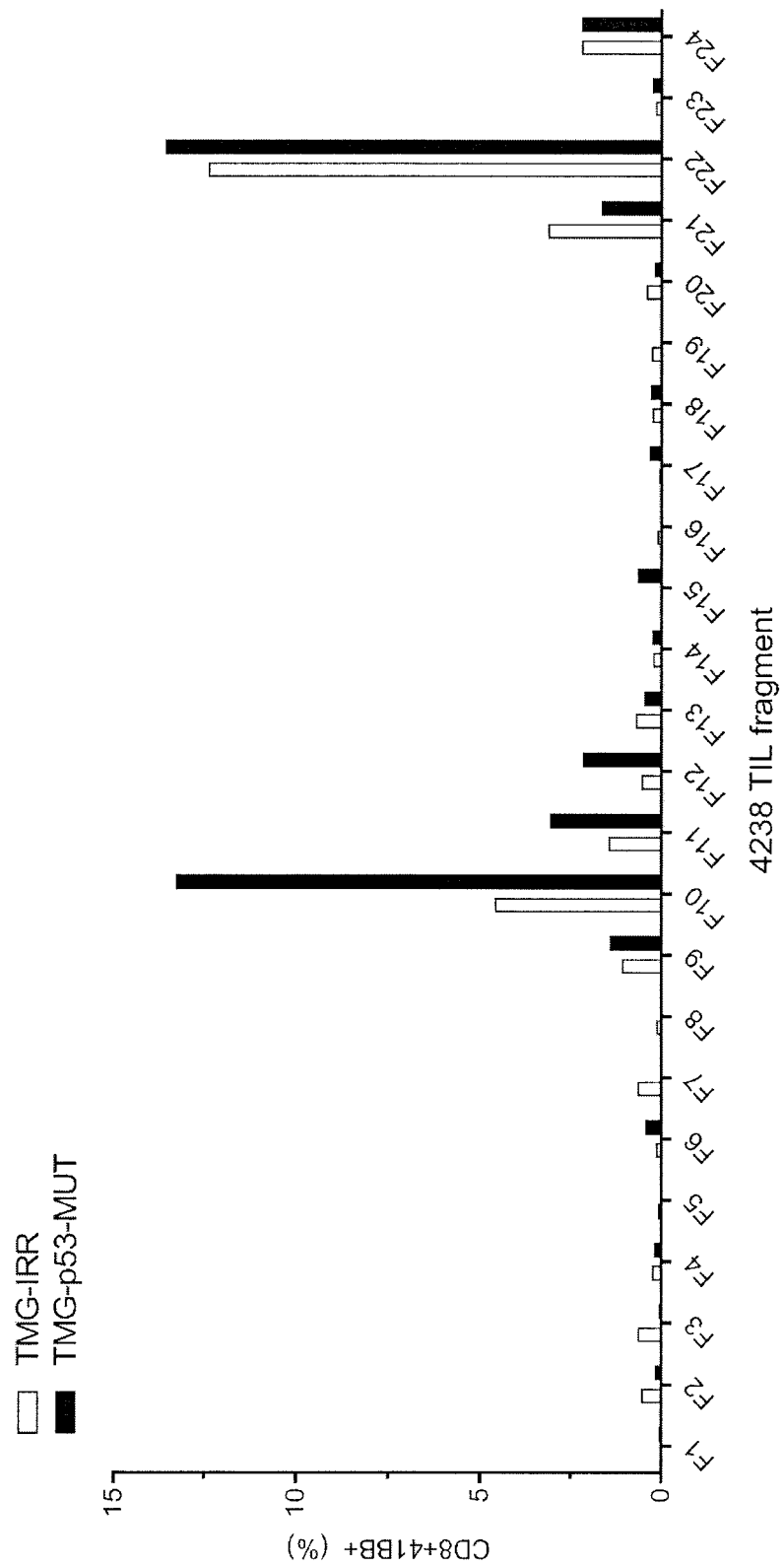
FIG. 14 is a graph showing the percentage of CD8+4-1BB+ cells detected following co-culture of Patient 4238 TIL fragments F1-F24 (n=24) with autologous APCs electroporated with TMG composed of irrelevant (IRR; open bars) or mutated p53 (p53-MUT; black bars) sequence.

TIL fragments (F1-F24, n=24) from patient 4238 were co-cultured with autologous APCs electroporated with TMG composed of the irrelevant or mutated p53 sequence. Co-cultures were performed overnight at 37° C. Secretion of IFN-γ was evaluated using ELISPOT assay. The results are shown in FIG. 12. Expression of 4-1BB was evaluated by flow cytometry after gating for lymphocytes→living cells (PI negative)→CD3+ (T cells). The results are shown in FIG. 14.

Figure 13:
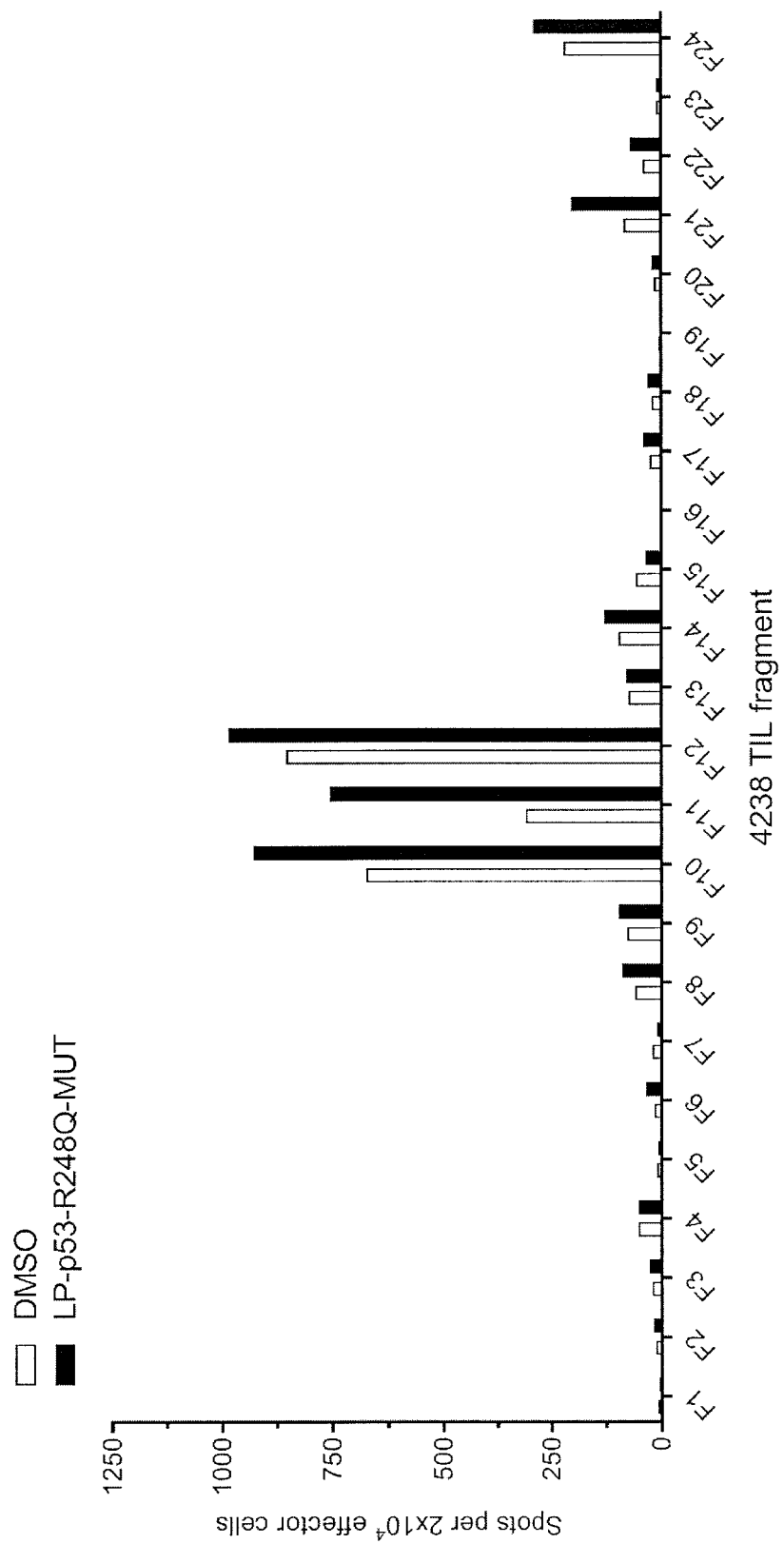
FIG. 13 is a graph showing the number of IFN-γ-positive spots per $2 \times 10^4$ effector cells measured following co-culture of Patient 4238 TIL fragments F1-F24 (n=24) with autologous APCs pulsed with peptide vehicle (DMSO; open bars) or purified (>95% by HPLC) 25-amino acid peptide composed of mutated p53-R248Q (LP-p53-R248Q-MUT; black bars) sequence.
Figure 15:
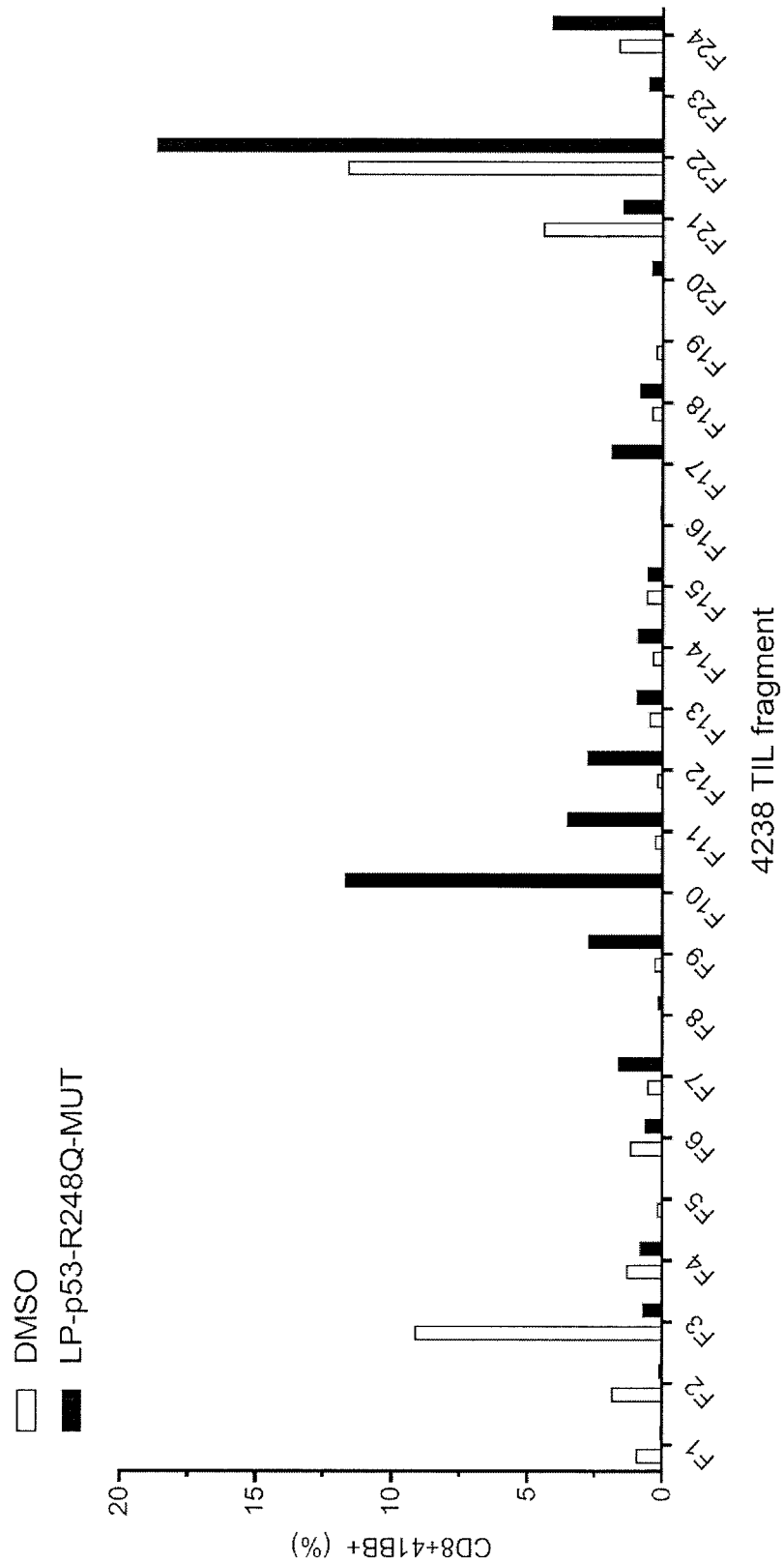
FIG. 15 is a graph showing the percentage of CD8+4-1 BB+ cells detected following co-culture of Patient 4238 TIL fragments F1-F24 (n=24) with autologous APCs pulsed with peptide vehicle (DMSO; open bars) or purified (>95% by HPLC) 25-amino acid peptide composed of mutated p53-R248Q (LP-p53-R248Q-MUT; black bars) sequence.

TIL fragments (F1-F24, n=24) from patient 4238 were co-cultured with autologous APCs pulsed with peptide vehicle (DMSO) or purified (>95% by HPLC) 25-amino acid peptide composed of the mutated p53-R248Q sequence. Co-cultures were performed overnight at 37° C. Secretion of IFN-γ was evaluated using ELISPOT assay. The results are shown in FIG. 13. Expression of 4-1BB was evaluated by flow cytometry after gating for lymphocytes→living cells (PI negative)→CD3+ (T cells). The results are shown in FIG. 15.

TIL fragments F10, F11 and F17 were sources of TCRs after sorting CD8+41BB+ T cells.

The sequence of TCR 4238-F10-TCR1, which was isolated from Patient 4238, is set forth below. Starting from the amino terminus, the first underlined region is the CDR1alpha (SEQ ID NO: 207), the second underlined region is the CDR2alpha (SEQ ID NO: 208), the third underlined region is the CDR3alpha (SEQ ID NO: 209), the fourth underlined region is the CDR1beta (SEQ ID NO: 210), the fifth underlined region is the CDR2beta (SEQ ID NO: 211), and the sixth underlined region is the CDR3beta (SEQ ID NO: 212). The bold region is the linker (SEQ ID NO: 26). Starting from the amino terminus, the first italicized region is the alpha chain constant region (SEQ ID NO: 23) and the second italicized region is the beta chain constant region (SEQ ID NO: 25). The alpha chain variable region (SEQ ID NO: 213) includes the sequence starting from the amino terminus and ending immediately prior to the start of the alpha chain constant region. The beta chain variable region (SEQ ID NO: 214) includes the sequence starting immediately after the linker and ending immediately prior to the start of the beta chain constant region. The full-length alpha chain (SEQ ID NO: 215) includes the sequence starting from the amino terminus and ending immediately prior to the start of the linker. The full-length beta chain (SEQ ID NO: 216) includes the sequence starting immediately after the linker and ending with the carboxyl terminus.

Cancer reactive T cells were identified using the screening method set forth below. The method used to isolate the TCR is set forth below.

TCR name: 4238-F10-TCR1
Recognition of p53 mutation: R248Q
Screening method: p53 "hotspot" mutation universal screening
Co-culture to identify TCR: Co-culture 4238-F10 with R248Q long peptide, sorted CD8+41BB+ T cells
Method to identify TCR: single-cell reverse transcriptase polymerase chain reaction (RT-PCR)
Abundance of TCR amongst all paired TCRs: 25.0% (observed 3 times of 12 pairs)
TCR orientation: alpha-beta
Expression vector: SB transposon (SEQ ID NO: 550)
MATASLLRAVIASICVVSSMAQKVTQAQTEISVVEKEDVTLDCVYETRDTT
YYLFWYKQPPSGELVFLIRRNSFDEQNEISGRYSWNFQKSTSSFNFTITAS
QVVDSAVYFCALSEVDSGNTPLVFGKGTRLSVIANIQNPEPAVYQLKDPRS
QDSTLCLFTDFDSQINVPKTMESGTFITDKCVLDMKAMDSKSNGAIAWSNQ
TSFTCQDIFKETNATYPSSDVPCDATLTEKSFETDMNLNFQNLLVIVLRIL
LLKVAGFNLLMTLRLWSSRAKRSGSGATNFSLLKQAGDVEENPGPMHFRLL
CCVAFCLLGAGPVDSGVTQTPKHLITATGQRVTLRCSPRSGDLSVYWYQQS
LDQGLQFLIQYYNGEERAKGNILERFSAQQFPDLHSELNLSSLELGDSALY
FCASSVGSSSSTDTQYFGPGTRLTVLEDLRNVTPPKVSLFEPSKAEIANKQ
KATLVCLARGFFPDHVELSWWVNGKEVHSGVCTDPQAYKESNYSYCLSSRL
RVSATFWHNPRNHFRCQVQFHGLSEEDKWPEGSPKPVTQNISAEAWGRADC
GITSASYQQGVLSATILYEILLGKATLYAVLVSTLVVMAMVKRKNS The statistics for TCR 4238-F10-TCR1 for Patient 4238 are set forth in Table 6 below.

TABLE 6

| Parameter | # | Frequency |
|---|---|---|
| Total wells | 96 | 100% |
| CDR3alpha | 4 | 4.2% |
| CDR3beta | 4 | 4.2% |
| 4238-F10-TCR1 pairs | 3 | 3.1% |
| Total paired TCRs | 12 | 12.5% |

The sequence of TCR 4238-F10-TCR2, which was isolated from Patient 4238, is set forth below. Starting from the amino terminus, the first underlined region is the CDR1alpha (SEQ ID NO: 217), the second underlined region is the CDR2alpha (SEQ ID NO: 218), the third underlined region is the CDR3alpha (SEQ ID NO: 219), the fourth underlined region is the CDR1beta (SEQ ID NO: 220), the fifth underlined region is the CDR2beta (SEQ ID NO: 221), and the sixth underlined region is the CDR3beta (SEQ ID NO: 222). The bold region is the linker (SEQ ID NO: 26). Starting from the amino terminus, the first italicized region is the alpha chain constant region (SEQ ID NO: 23) and the second italicized region is the beta chain constant region (SEQ ID NO: 25). The alpha chain variable region (SEQ ID NO: 223) includes the sequence starting from the amino terminus and ending immediately prior to the start of the alpha chain constant region. The beta chain variable region (SEQ ID NO: 224) includes the sequence starting immediately after the linker and ending immediately prior to the start of the beta chain constant region. The full-length alpha chain (SEQ ID NO: 225) includes the sequence starting from the amino terminus and ending immediately prior to the start of the linker. The full-length beta chain (SEQ ID NO: 226) includes the sequence starting immediately after the linker and ending with the carboxyl terminus.

Cancer reactive T cells were identified using the screening method set forth below. The method used to isolated the TCR is set forth below.

TCR name: 4238-F10-TCR2
Recognition of p53 mutation: R248Q
Screening method: p53 "hotspot" mutation universal screening
Co-culture to identify TCR: Co-culture 4238-F10 with R248Q long peptide, sorted CD8+41BB+ T cells
Method to identify TCR: single-cell RT-PCR
Abundance of TCR amongst all paired TCRs: 25.0% (observed 3 times of 12 pairs)
TCR orientation: alpha-beta
Expression vector: SB transposon (SEQ ID NO: 551)
MATASLLRAVIASICVVSSMAQKVTQAQTEISVVEKEDVTLDCVYETRDTT
YYLFWYKQPPSGELVFLIRRNSFDEQNEISGRYSWNFQKSTSSFNFTITAS
QVVDSAVYFCALSEVDSGNTPLVFGKGTRLSVIANIQNPEPAVYQLKDPRS
QDSTLCLFTDFDSQINVPKTMESGTFITDKCVLDMKAMDSKSNGAIAWSNQ
TSFTCQDIFKETNATYPSSDVPCDATLTEKSFETDMNLNFQNLLVIVLRIL
LLKVAGFNLLMTLRLWSSRAKRSGSGATNFSLLKQAGDVEENPGPMHFRLL
CCVAFCLLGAGPVDSGVTQTPKHLITATGQRVTLRCSPRSGDLSVYWYQQS
LDQGLQFLIHYYNGEERAKGNILERFSAQQFPDLHSELNLSSLELGDSALY
FCASSVGSSSSTDTQYFGPGTRLTVLEDLRNVIPPKVSLFEPSKAEIANKQ
KATLVCLARGFFPDHVELSWWVNGKEVHSGVCTDPQAYKESNYSYCLSSRL
RVSATFWHNPRNHFRCQVQFHGLSEEDKWPEGSPKPVTQNISAEAWGRADC
GITSASYQQGVLSATILYEILLGKATLYAVLVSTLVVMAMVKRKNS The statistics for TCR 4238-F10-TCR2 for Patient 4238 are set forth in Table 7 below.

TABLE 7

| Parameter | # | Frequency |
|---|---|---|
| Total wells | 96 | 100% |
| CDR3alpha | 4 | 4.2% |
| CDR3beta | 4 | 4.2% |
| 4238-F10-TCR2 pairs | 3 | 3.1% |
| Total paired TCRs | 12 | 12.5% |

The sequence of TCR 4238-F10-TCR3, which was isolated from Patient 4238, is set forth below. Starting from the amino terminus, the first underlined region is the CDR1alpha (SEQ ID NO: 227), the second underlined region is the CDR2alpha (SEQ ID NO: 228), the third underlined region is the CDR3alpha (SEQ ID NO: 229), the fourth underlined region is the CDR1beta (SEQ ID NO: 230), the fifth underlined region is the CDR2beta (SEQ ID NO: 231), and the sixth underlined region is the CDR3beta (SEQ ID NO: 232). The bold region is the linker (SEQ ID NO: 26). Starting from the amino terminus, the first italicized region is the alpha chain constant region (SEQ ID NO: 23) and the second italicized region is the beta chain constant region (SEQ ID NO: 25). The alpha chain variable region (SEQ ID NO: 233) includes the sequence starting from the amino terminus and ending immediately prior to the start of the alpha chain constant region. The beta chain variable region (SEQ ID NO: 234) includes the sequence starting immediately after the linker and ending immediately prior to the start of the beta chain constant region. The full-length alpha chain (SEQ ID NO: 235) includes the sequence starting from the amino terminus and ending immediately prior to the start of the linker. The full-length beta chain (SEQ ID NO: 236) includes the sequence starting immediately after the linker and ending with the carboxyl terminus.

Cancer reactive T cells were identified using the screening method set forth below. The method used to isolate the TCR is set forth below.

TCR name: 4238-F10-TCR3
Recognition of p53 mutation: R248Q
Screening method: p53 "hotspot" mutation universal screening
Co-culture to identify TCR: Co-culture 4238-F10 with R248Q long peptide, sorted CD8+41BB+ T cells
Method to identify TCR: single-cell RT-PCR
Abundance of TCR amongst all paired TCRs: 58.3% (observed 7 times of 12 pairs)
TCR orientation: alpha-beta
Expression vector: SB transposon (SEQ ID NO: 552)
MAKSLRVLLVILWLQLSWVWSQQKEVEQDPGPLSVPEGAIVSLNCTYSNSA

FQYFMWYRQYSRKGPELLMYTYSSGNKEDGRFTAQVDKSSKYISLFIRDSQ

PSDSATYLCAMTSPYNNNDMRFGAGTRLTVKPNIQNPEPAVYQLKDPRSQD

STLCLFTDFDSQINVPKTMESGTFITDKCVLDMKAMDSKSNGAIAWSNQTS

FTCQDIFKETNATYPSSDVPCDATLTEKSFETDMNLNFQNLLVIVLRILLL

KVAGENLLMTLRLWSSRAKRSGSGATNFSLLKQAGDVEENPGPMHLLLLLL

GPGISLLLPGSLAGSGLGAVVSQHPSWVICKSGTSVKIECRSLDFQATTMF

WYRQFPKQSLMLMATSNEGSKATYEQGVEKDKFLINHASLTLSTLTVTSAH

PEDSSFYICSGGLEEAARQFIGPGTRLTVLEDLRNVTPPKVSLFEPSKAEI

ANKQKATLVCLARGFFPDHVELSWWVNGKEVHSGVCTDPQAYKESNYSYCL

SSRLRVSATFWHNPRNHFRCQVQFHGLSEEDKWPEGSPKPVTQNISAEAWG

RADCGITSASYQQGVLSATILYEILLGKATLYAVLVSTLVVMAMVKRKNS

The statistics for TCR 4238-F10-TCR3 for Patient 4238 are set forth in Table 8 below.

TABLE 8

| Parameter | # | Frequency |
|---|---|---|
| Total wells | 96 | 100% |
| CDR3alpha | 16 | 16.7% |
| CDR3beta | 26 | 27.1% |
| 4238-F10-TCR3 pairs | 7 | 7.3% |
| Total paired TCRs | 12 | 12.5% |

The sequence of TCR 4238-F10-TCR4, which was isolated from Patient 4238, is set forth below. Starting from the amino terminus, the first underlined region is the CDR1alpha (SEQ ID NO: 237), the second underlined region is the CDR2alpha (SEQ ID NO: 238), the third underlined region is the CDR3alpha (SEQ ID NO: 239), the fourth underlined region is the CDR1beta (SEQ ID NO: 240), the fifth underlined region is the CDR2beta (SEQ ID NO: 241), and the sixth underlined region is the CDR3beta (SEQ ID NO: 242). The bold region is the linker (SEQ ID NO: 26). Starting from the amino terminus, the first italicized region is the alpha chain constant region (SEQ ID NO: 23) and the second italicized region is the beta chain constant region (SEQ ID NO: 25). The alpha chain variable region (SEQ ID NO: 243) includes the sequence starting from the amino terminus and ending immediately prior to the start of the alpha chain constant region. The beta chain variable region (SEQ ID NO: 244) includes the sequence starting immediately after the linker and ending immediately prior to the start of the beta chain constant region. The full-length alpha chain (SEQ ID NO: 245) includes the sequence starting from the amino terminus and ending immediately prior to the start of the linker. The full-length beta chain (SEQ ID NO: 246) includes the sequence starting immediately after the linker and ending with the carboxyl terminus.

Cancer reactive T cells were identified using the screening method set forth below. The method used to isolate the TCR is set forth below.

TCR name: 4238-F10-TCR4
Recognition of p53 mutation: R248Q
Screening method: p53 "hotspot" mutation universal screening
Co-culture to identify TCR: Co-culture 4238-F10 with R248Q long peptide, sorted CD8+41BB+ T cells
Method to identify TCR: single-cell RT-PCR
Abundance of TCR amongst all paired TCRs: 58.3% (observed 7 times of 12 pairs)
TCR orientation: alpha-beta
Expression vector: SB transposon (SEQ ID NO: 553)
MAKSLRVLLVILWLQLSWVWSQQKEVEQDPGPLSVPEGAIVSLNCTYSNSA

FQYFMWYRQYSRKGPELLMYTYSSGNKEDGRFTAQVDKSSKYISLFIRDSQ

PSDSATYLCAMTSPYNNNDMRFGAGTRLTVKPNIQNPEPAVYQLKDPRSQD

STLCLFTDFDSQINVPKTMESGTFITDKCVLDMKAMDSKSNGAMWSNQTSF

TCQDIFKETNATYPSSDVPCDATLTEKSFETDMNLNFQNLLVIVLRILLLK

VAGFAILLMTLRLWSSRAKRSGSGATNFSLLKQAGDVEENPGPMHLLLLLL

GPAGSGLGAVVSQHPSRVICKSGTSVKIECRSLDFQATTMFWYRQFPKQSL

MLMATSNEGSKATYEQGVEKDKFLINHASLTLSTLTVTSAHPEDSSFYICS

GGLEEAARQFIGPGTRLTVLEDLRNVTPPKVSLFEPSKAEIANKQKATLVC

LARGFFPDHVELSWWVNGKEVHSGVCTDPQAYKESNYSYCLSSRLRVSATF

WHNPRNHFRCQVQFHGLSEEDKWPEGSPKPVTQNISAEAWGRADCGITSAS

YQQGVLSATILYEILLGKATLYAVLVSTLVVMAMVKRKNS

The statistics for TCR 4238-F10-TCR4 for Patient 4238 are set forth in Table 9 below.

TABLE 9

| Parameter | # | Frequency |
|---|---|---|
| Total wells | 96 | 100% |
| CDR3alpha | 16 | 16.7% |
| CDR3beta | 26 | 27.1% |
| 4238-F10-TCR4 pairs | 7 | 7.3% |
| Total paired TCRs | 12 | 12.5% |

The sequence of TCR 4238-F11-TCR1, which was isolated from Patient 4238, is set forth below. Starting from the amino terminus, the first underlined region is the CDR1alpha (SEQ ID NO: 247), the second underlined region is the CDR2alpha (SEQ ID NO: 248), the third underlined region is the CDR3alpha (SEQ ID NO: 249), the fourth underlined region is the CDR1beta (SEQ ID NO: 250), the fifth underlined region is the CDR2beta (SEQ ID NO: 251), and the sixth underlined region is the CDR3beta (SEQ ID NO: 252). The bold region is the linker (SEQ ID NO: 26). Starting from the amino terminus, the first italicized region is the alpha chain constant region (SEQ ID NO: 23) and the second italicized region is the beta chain constant region (SEQ ID NO: 25). The alpha chain variable region (SEQ ID NO: 253) includes the sequence starting from the amino terminus and ending immediately prior to the start of the alpha chain constant region. The beta chain variable region (SEQ ID NO: 254) includes the sequence starting immediately after the linker and ending immediately prior to the start of the beta chain constant region. The full-length alpha chain (SEQ ID NO: 255) includes the sequence starting from the amino terminus and ending immediately prior to the start of the linker. The full-length beta chain (SEQ ID NO: 256) includes the sequence starting immediately after the linker and ending with the carboxyl terminus.

Cancer reactive T cells were identified using the screening method set forth below. The method used to isolate the TCR is set forth below.

TCR name: 4238-F11-TCR1

Recognition of p53 mutation: R248Q

Screening method: p53 "hotspot" mutation universal screening

Co-culture to identify TCR: Co-culture 4238-F11 with R248Q long peptide, sorted CD8+41BB+ T cells Method to identify TCR: single-cell RT-PCR Abundance of TCR amongst all paired TCRs: 25.0% (observed 3 times of 12 pairs)

TCR orientation: alpha-beta

Expression vector: SB transposon (SEQ ID NO: 554)
MALVARVTVFLTFGTIIDAKTTQPPSMDCAEGRAANLPCNHSTISGNEYVY

WYRQIHSQGPQYIIHGLKNNETNEMASLIITEDRKSSTLILPHATLRDTAV

YYCIVPNDYKLSFGAGTTVTVRA*NIQNPEPAVYQLKDPRSQDSTLCLFTDF*

*DSQINVPKTMESGTFITDKCVLDMKAMDSKSNGAIAWSNQTSFTCQDIFKE*

*TNATYPSSDVPCDATLTEKSFETDMNLNFQNLLKLVIVLRILLLKVAGFNK*

*KMTLRLWSS*__RAKRSGSGATNFSLLKQAGDVEENPGP__MHIRLLCRVAFCFLA

VGLVDVKVTQSSRYLVKRTGEKVFLECVQDMDHENMFWYRQDPGLGLRLIY

FSYDVKMKEKGDIPEGYSVSREKKERFSLILESASTNQTSMYLCASSFGTG

SIQETQYFGPGTRLLVL*EDLRNVTPPKVSLFEPSKAEIANKQKATLVCLAR*

*WGFFPDHVELSWVNGKEVHSGVCTDPQAYKESNYSYCLSSRLRVSATFWHN*

*PRNHFRCQVQFHGLSEEDKWPEGSPKPVTQNISAEAWGRADCGITSASYQQ*

*GVLSATILYEILLGKATLYAVLVSTLVVMAMVKRKNS*

The statistics for TCR 4238-F11-TCR1 for Patient 4238 are set forth in Table 10 below.

TABLE 10

| Parameter | # | Frequency |
|---|---|---|
| Total wells | 96 | 100% |
| CDR3alpha | 5 | 5.2% |
| CDR3beta | 3 | 3.1% |
| 4238-F11-TCR1 pairs | 3 | 3.1% |
| Total paired TCRs | 12 | 12.5% |

The sequence of TCR 4238-F11-TCR2, which was isolated from Patient 4238, is set forth below. Starting from the amino terminus, the first underlined region is the CDR1alpha (SEQ ID NO: 257), the second underlined region is the CDR2alpha (SEQ ID NO: 258), the third underlined region is the CDR3alpha (SEQ ID NO: 259), the fourth underlined region is the CDR1beta (SEQ ID NO: 260), the fifth underlined region is the CDR2beta (SEQ ID NO: 261), and the sixth underlined region is the CDR3beta (SEQ ID NO: 262). The bold region is the linker (SEQ ID NO: 262). Starting from the amino terminus, the first italicized region is the alpha chain constant region (SEQ ID NO: 23) and the second italicized region is the beta chain constant region (SEQ ID NO: 25). The alpha chain variable region (SEQ ID NO: 263) includes the sequence starting from the amino terminus and ending immediately prior to the start of the alpha chain constant region. The beta chain variable region (SEQ ID NO: 264) includes the sequence starting immediately after the linker and ending immediately prior to the start of the beta chain constant region. The full-length alpha chain (SEQ ID NO: 265) includes the sequence starting from the amino terminus and ending immediately prior to the start of the linker. The full-length beta chain (SEQ ID NO: 266) includes the sequence starting immediately after the linker and ending with the carboxyl terminus.

Cancer reactive T cells were identified using the screening method set forth below. The method used to isolate the TCR is set forth below.

TCR name: 4238-F11-TCR2

Recognition of p53 mutation: R248Q

Screening method: p53 "hotspot" mutation universal screening

Co-culture to identify TCR: Co-culture 4238-F11 with R248Q long peptide, sorted CD8+41BB+ T cells Method to identify TCR: single-cell RT-PCR Abundance of TCR amongst all paired TCRs: 25.0% (observed 3 times of 12 pairs)

TCR orientation: alpha-beta

Expression vector: SB transposon (SEQ ID NO: 555)
MAYSPGLVSLILLLLGRTRGNSVTQMEGPVTLSEEEAFLTINCTYTATGYPS

LFWYVQYPGEGLQLLLKATKADDKGSNKGFEATYRKETTSFHLEKGSVQVS

DSAVYFCALNPNAGGTSYGKLTFGQGTILTVHP*NIQNPEPAVYQLKDPRSQ*

*DSTLCLFTDFDSQINVPKTMESGTFITDKCVLDMKAMDSKSNGAIAWSNQT*

*SFTCQDIFKETNATYPSSDVPCDATLTEKSFETDMNLNFQNLLVIVLRILL*

*LKVAGFNLLMTLRLWSS*__RAKRSGSGATNFSLLKQAGDVEENPGP__MHPRLLF

WALLCLLGTGPVEAGVTQSPTHLIKTRGQQATLRCSPISGHTSVYWYQQAL

GLGLQFLLWYDEGEERNRGNFPPRFSGRQFPNYSSELNVNALELEDSALYL

CASSSVGATSGGANTGELFFGEGSRLTVL*EDLRNVTPPKVSLFEPSKAEIA*

-continued

NKQKATLCLLARGFFPDHVELSWWVNGKEVHSGVCTDPQAYKESNYSYCLS

SRLRVSATFWHNPRNHFRCQVQFHGLSEEDKWPEGSPKPVTQNISAEAWGR

ADCGITSASYQQGVLSATILYEILLGKATLYAVLVSTLVVMAMVKRKNS

The statistics for TCR 4238-F11-TCR2 for Patient 4238 are set forth in Table 11 below.

TABLE 11

| Parameter | # | Frequency |
|---|---|---|
| Total wells | 96 | 100% |
| CDR3alpha | 5 | 5.2% |
| CDR3beta | 8 | 8.3% |
| 4238-F11-TCR2 pairs | 3 | 3.1% |
| Total paired TCRs | 12 | 12.5% |

The sequence of TCR 4238-F11-TCR3, which was isolated from Patient 4238, is set forth below. Starting from the amino terminus, the first underlined region is the CDR1alpha (SEQ ID NO: 267), the second underlined region is the CDR2alpha (SEQ ID NO: 268), the third underlined region is the CDR3alpha (SEQ ID NO: 269), the fourth underlined region is the CDR1beta (SEQ ID NO: 270), the fifth underlined region is the CDR2beta (SEQ ID NO: 271), and the sixth underlined region is the CDR3beta (SEQ ID NO: 272). The bold region is the linker (SEQ ID NO: 26). Starting from the amino terminus, the first italicized region is the alpha chain constant region (SEQ ID NO: 23) and the second italicized region is the beta chain constant region (SEQ ID NO: 25). The alpha chain variable region (SEQ ID NO: 273) includes the sequence starting from the amino terminus and ending immediately prior to the start of the alpha chain constant region. The beta chain variable region (SEQ ID NO: 274) includes the sequence starting immediately after the linker and ending immediately prior to the start of the beta chain constant region. The full-length alpha chain (SEQ ID NO: 275) includes the sequence starting from the amino terminus and ending immediately prior to the start of the linker. The full-length beta chain (SEQ ID NO: 276) includes the sequence starting immediately after the linker and ending with the carboxyl terminus.

Cancer reactive T cells were identified using the screening method set forth below. The method used to isolate the TCR is set forth below.
  TCR name: 4238-F11-TCR3
  Recognition of p53 mutation: R248Q
  Screening method: p53 "hotspot" mutation universal screening
  Co-culture to identify TCR: Co-culture 4238-F11 with R248Q long peptide, sorted CD8+41BB+ T cells
  Method to identify TCR: single-cell RT-PCR
  Abundance of TCR amongst all paired TCRs: 16.7% (observed 2 times of 12 pairs)
  TCR orientation: alpha-beta
  Expression vector: SB transposon (SEQ ID NO: 556)
MATFAGFSFLFLWLQLDCMSRGEDVEQSLFLSVREGDSSVINCTYTDSSST

YLYWYKQEPGAGLQLLTYIFSNMDMKQDQRLTVLLNKKDKHLSLRIADTQT

GDSAIYFCAEIPRDSGGGADGLTFGKGTHLIIQPNIQNPEPAVYQLKDPRS

QDSTLCLFTDFDSQINVPKTMESGTFITDKCVLDMKAMDSKSNGAIAWSNQ

TSFTCQDIFKETNATYPSSDVPCDATLTEKSFETDMNLNFQNLLVIVLRIL

LLKVAGFNLLMTLRLWSSRAKRSGSGATNFSLLKQAGDVEENPGPMHLLLL

LGPGISLLLPGSLAGSGLGAVVSQHPSWVICKSGTSVKIECRSLDFQATTM

FWYRQFPKQSLMLMATSNEGSKATYEQGVEKDKFLINHASLTLSTLTVTSA

HPEDSSFYICSARDLQRSYEQYFGPGTRLTVTEDLRNVTPPKVSLFEPSKA

EIANKQKATLVCLARGFFPDHVELSWWVNGKEVHSGVCTDPQAYKESNYSY

CLSSRLRVSATFWHNPRNHFRCQVQFHGLSEEDKWPEGSPKPVTQNISAEA

WGRADCGITSASYQQGVLSATILYEILLGKATLYAVLVSTLVVMAMVKRKN

S

The statistics for TCR 4238-F11-TCR3 for Patient 4238 are set forth in Table 12 below.

TABLE 12

| Parameter | # | Frequency |
|---|---|---|
| Total wells | 96 | 100% |
| CDR3alpha | 4 | 4.2% |
| CDR3beta | 2 | 2.1% |
| 4238-F11-TCR3 pairs | 2 | 2.1% |
| Total paired TCRs | 12 | 12.5% |

The sequence of TCR 4238-F11-TCR4, which was isolated from Patient 4238, is set forth below. Starting from the amino terminus, the first underlined region is the CDR1alpha (SEQ ID NO: 277), the second underlined region is the CDR2alpha (SEQ ID NO: 278), the third underlined region is the CDR3alpha (SEQ ID NO: 279), the fourth underlined region is the CDR1beta (SEQ ID NO: 280), the fifth underlined region is the CDR2beta (SEQ ID NO: 281), and the sixth underlined region is the CDR3beta (SEQ ID NO: 282). The bold region is the linker (SEQ ID NO: 26). Starting from the amino terminus, the first italicized region is the alpha chain constant region (SEQ ID NO: 23) and the second italicized region is the beta chain constant region (SEQ ID NO: 25). The alpha chain variable region (SEQ ID NO: 283) includes the sequence starting from the amino terminus and ending immediately prior to the start of the alpha chain constant region. The beta chain variable region (SEQ ID NO: 284) includes the sequence starting immediately after the linker and ending immediately prior to the start of the beta chain constant region. The full-length alpha chain (SEQ ID NO: 285) includes the sequence starting from the amino terminus and ending immediately prior to the start of the linker. The full-length beta chain (SEQ ID NO: 286) includes the sequence starting immediately after the linker and ending with the carboxyl terminus.

Cancer reactive T cells were identified using the screening method set forth below. The method used to isolate the TCR is set forth below.
  TCR name: 4238-F11-TCR4
  Recognition of p53 mutation: R248Q
  Screening method: p53 "hotspot" mutation universal screening
  Co-culture to identify TCR: Co-culture 4238-F11 with R248Q long peptide, sorted CD8+41BB+ T cells
  Method to identify TCR: single-cell RT-PCR Abundance of TCR amongst all paired TCRs: 16.7% (observed 2 times of 12 pairs)
TCR orientation: alpha-beta
Expression vector: SB transposon (SEQ ID NO: 557)
MATFAGFSFLFLWLQLDCMSRGEDVEQSLFLSVREGDSSVINCTYTDSSST

YLYWYKQEPGAGLQLLTYIFSNMDMKQDQRLTVLLNKKDKHLSLRIADTQT

GDSAIYFCAEIPRDSGGGADGLTFGKGTHLIIQPN*IQNPEPAVYQLKDPRS*

*QDSTLCLFTDFDSQINVPKTMESGTFITDKCVLDMKAMDSKSNGAIAWSNQ*

*TSFTCQDIFKETNATYPSSDVPCDATLTEKSFETDMNLNFQNLLVIVLRIL*

*LLKVAGFNLLMTLRLWSS*RAKRSGSGATNFSLLKQAGDVEENPGPMHLLLL

LGPAGSGLGAVVSQHPSRVICKSGTSVKIECRSLDFQATTMFWYRQFPKQS

LMLMATSNEGSKATYEQGVEKDKFLINHASLTLSTLTVTSAHPEDSSFYIC

SARDLQRSYEQYFGPGTRLTVT*EDLRNVTPPKVSLFEPSKAEIANKQKATL*

*VCLARGEFPDHVELSWWVNGKEVHSGVCTDPQAYKESNYSYCLSSRLRVSA*

*TEWHNPRNHFRCQVQFHGLSEEDKWPEGSPKPVTQNISAEAWGRADCGITS*

*ASYQQGVLSATILYEILLGKATLYAVLVSTLVVMAMVKRKNS*

The statistics for TCR 4238-F11-TCR4 for Patient 4238 are set forth in Table 13 below.

TABLE 13

| Parameter | # | Frequency |
|---|---|---|
| Total wells | 96 | 100% |
| CDR3alpha | 4 | 4.2% |
| CDR3beta | 2 | 2.1% |
| 4238-F11-TCR4 pairs | 2 | 2.1% |
| Total paired TCRs | 12 | 12.5% |

The sequence of TCR 4238-F17-TCR1, which was isolated from Patient 4238, is set forth below. Starting from the amino terminus, the first underlined region is the CDR1alpha (SEQ ID NO: 287), the second underlined region is the CDR2alpha (SEQ ID NO: 288), the third underlined region is the CDR3alpha (SEQ ID NO: 289), the fourth underlined region is the CDR1beta (SEQ ID NO: 290), the fifth underlined region is the CDR2beta (SEQ ID NO: 291), and the sixth underlined region is the CDR3beta (SEQ ID NO: 292). The bold region is the linker (SEQ ID NO: 26). Starting from the amino terminus, the first italicized region is the alpha chain constant region (SEQ ID NO: 23) and the second italicized region is the beta chain constant region (SEQ ID NO: 25). The alpha chain variable region (SEQ ID NO: 293) includes the sequence starting from the amino terminus and ending immediately prior to the start of the alpha chain constant region. The beta chain variable region (SEQ ID NO: 294) includes the sequence starting immediately after the linker and ending immediately prior to the start of the beta chain constant region. The full-length alpha chain (SEQ ID NO: 295) includes the sequence starting from the amino terminus and ending immediately prior to the start of the linker. The full-length beta chain (SEQ ID NO: 296) includes the sequence starting immediately after the linker and ending with the carboxyl terminus.

Cancer reactive T cells were identified using the screening method set forth below. The method used to isolate the TCR is set forth below.

TCR name: 4238-F17-TCR1
Recognition of p53 mutation: R248Q
Screening method: p53 "hotspot" mutation universal screening
Co-culture to identify TCR: Co-culture 4238-F17 with R248Q long peptide, sorted CD8+41BB+ T cells
Method to identify TCR: single-cell RT-PCR
Abundance of TCR amongst all paired TCRs: 33.3% (observed 2 times of 6 pairs)
TCR orientation: alpha-beta
Expression vector: SB transposon (SEQ ID NO: 558)
MAGIRALFMYLWLQLDWVSRGESVGLHLPTLSVQEGDNSIINCAYSNSASD

YFIWYKQESGKGPQFIIDIRSNMDKRQGQRVTVLLNKTVKHLSLQIAATQP

GDSAVYFCAEPVGGLNSGYALNFGKGTSLLVTPN*IQNPEPAVYQLKDPRSQ*

*DSTLCLFTDFDSQINVPKTMESGTFITDKCVLDMKAMDSKSNGAIAWSNQT*

*SFTCQDIFKETNATYPSSDVPCDATLTEKSFETDMNLNFQNLLVIVLRILL*

*LKVAGFNLLMTLRLWSS*RAKRSGSGATNFSLLKQAGDVEENPGPMHPGLLC

WVLLCLLGAGPVDAGVTQSPTHLIKTRGQQVTLRCSPISGHKSVSWYQQVL

GQGPQFIFQYYEKEERGRGNFPDRFSARQFPNYSSELNVNALLLGDSALYL

CASSGGRTSGAYEQFFGPGTRLTV*LEDLRNVTPPKVSLFEPSKAEIANKQK*

*CATLVLARGFFPDHVELSWWVNGKEVHSGVCTDPQAYKESIVYSYCLSSRL*

*RVSATFWHNPRNHFRCQVQFHGLSEEDKWPEGSPKPVTQNISAEAWGRADC*

*GITSASYQQGVLSATILYEILLGKATLYAVLVSTLVVMAMVKRKNS*

The statistics for TCR 4238-F17-TCR1 for Patient 4238 are set forth in Table 14 below.

TABLE 14

| Parameter | # | Frequency |
|---|---|---|
| Total wells | 96 | 100% |
| CDR3alpha | 3 | 3.1% |
| CDR3beta | 2 | 2.1% |
| 4238-F17-TCR1 pairs | 2 | 2.1% |
| Total paired TCRs | 6 | 6.3% |

The sequence of TCR 4238-F17-TCR2, which was isolated from Patient 4238, is set forth below. Starting from the amino terminus, the first underlined region is the CDR1alpha (SEQ ID NO: 297), the second underlined region is the CDR2alpha (SEQ ID NO: 298), the third underlined region is the CDR3alpha (SEQ ID NO: 299), the fourth underlined region is the CDR1beta (SEQ ID NO: 300), the fifth underlined region is the CDR2beta (SEQ ID NO: 301), and the sixth underlined region is the CDR3beta (SEQ ID NO: 302). The bold region is the linker (SEQ ID NO: 26). Starting from the amino terminus, the first italicized region is the alpha chain constant region (SEQ ID NO: 23) and the second italicized region is the beta chain constant region (SEQ ID NO: 25). The alpha chain variable region (SEQ ID NO: 303) includes the sequence starting from the amino terminus and ending immediately prior to the start of the alpha chain constant region. The beta chain variable region (SEQ ID NO: 304) includes the sequence starting immediately after the linker and ending immediately prior to the start of the beta chain constant region. The full-length alpha chain (SEQ ID NO: 305) includes the sequence starting from the amino terminus and ending immediately prior to the start of the linker. The full-length beta chain (SEQ ID NO: 306) includes the sequence starting immediately after the linker and ending with the carboxyl terminus.

Cancer reactive T cells were identified using the screening method set forth below. The method used to isolate the TCR is set forth below.

TCR name: 4238-F17-TCR2
Recognition of p53 mutation: R248Q
Screening method: p53 "hotspot" mutation universal screening
Co-culture to identify TCR: Co-culture 4238-F17 with R248Q long peptide, sorted CD8+41BB+ T cells
Method to identify TCR: single-cell RT-PCR
Abundance of TCR amongst all paired TCRs: 33.3% (observed 2 times of 6 pairs)
TCR orientation: alpha-beta
Expression vector: SB transposon (SEQ ID NO: 559)
MAKMLECAFIVLWLQLGWLSGEDQVTQSPEALRLQEGESSSLNCSYTVSGL

RGLFWYRQDPGKGPEFLFTLYSAGEEKEKERLKATLTKKESFLHITAPKPE

DSATYLCAVTAHRGSTLGRLYFGRGTQLTVWPNIQNPEPAVYQLKDPRSQD

STLCLFTDFDSQINVPKTMESGTFITDKCVLDMKAMDSKSNGAIAWSNQTS

FTCQDIFKETNATYPSSDVPCDATLTEKSFETDMNLNFQNLLVIVLRILLL

KVAGFNLLMTLRLWSSRAKRSGSGATNFSLLKQAGDVEENPGPMHPGLLCW

ALLCLLGAGLVDAGVTQSPTHLIKTRGQQVTLRCSPKSGHDTVSWYQQALG

QGPQFIFQYYEEEERQRGNFPDRFSGHQFPNYSSELNVNALLLGDSALYLC

ASSRRGGAYNEQFFGPGTRLTVLEDLRNVTPPKVSLFEPSKAEIANKQKAT

LVCLARGFFPDHVELSWWVNGKEVHSGVCTDPQAYKESNYSYCLSSRLRVS

ATEWHNPRNHERCQVQFHGLSEEDKWPEGSPKPVTQNISAEAWGRADCGIT

SASYQQGVLSATILYEILLGKATLYAVLVSTLVVMAMVKRKNS

The statistics for TCR 4238-F17-TCR2 for Patient 4238 are set forth in Table 15 below.

TABLE 15

| Parameter | # | Frequency |
|---|---|---|
| Total wells | 96 | 100% |
| CDR3alpha | 6 | 6.3% |
| CDR3beta | 2 | 2.1% |
| 4238-F17-TCR2 pairs | 2 | 2.1% |
| Total paired TCRs | 6 | 6.3% |

The sequence of TCR 4238-F17-TCR3, which was isolated from Patient 4238, is set forth below. Starting from the amino terminus, the first underlined region is the CDR1alpha (SEQ ID NO: 307), the second underlined region is the CDR2alpha (SEQ ID NO: 308), the third underlined region is the CDR3alpha (SEQ ID NO: 309), the fourth underlined region is the CDR1beta (SEQ ID NO: 310), the fifth underlined region is the CDR2beta (SEQ ID NO: 311), and the sixth underlined region is the CDR3beta (SEQ ID NO: 312). The bold region is the linker (SEQ ID NO: 26). Starting from the amino terminus, the first italicized region is the alpha chain constant region (SEQ ID NO: 23) and the second italicized region is the beta chain constant region (SEQ ID NO: 25). The alpha chain variable region (SEQ ID NO: 313) includes the sequence starting from the amino terminus and ending immediately prior to the start of the alpha chain constant region. The beta chain variable region (SEQ ID NO: 314) includes the sequence starting immediately after the linker and ending immediately prior to the start of the beta chain constant region. The full-length alpha chain (SEQ ID NO: 315) includes the sequence starting from the amino terminus and ending immediately prior to the start of the linker. The full-length beta chain (SEQ ID NO: 316) includes the sequence starting immediately after the linker and ending with the carboxyl terminus.

Cancer reactive T cells were identified using the screening method set forth below. The method used to isolate the TCR is set forth below.

TCR name: 4238-F17-TCR3
Recognition of p53 mutation: R248Q
Screening method: p53 "hotspot" mutation universal screening
Co-culture to identify TCR: Co-culture 4238-F17 with R248Q long peptide, sorted CD8+41BB+ T cells
Method to identify TCR: single-cell RT-PCR
Abundance of TCR amongst all paired TCRs: 33.3% (observed 2 times of 6 pairs)
TCR orientation: alpha-beta
Expression vector: SB transposon (SEQ ID NO: 560)
MAKNPLAAPLLILWFHLDCVSSILNVEQSPQSLHVQEGDSTNFTCSFPSSN

FYALHWYRWETAKSPEALFVMTLNGDEKKKGRISATLNTKEGYSYLYIKGS

QPEDSATYLCASVGGGADGLTFGKGTHLIIQPNIQNPEPAVYQLKDPRSQD

STLCLFTDFDSQINVPKTMESGTFITDKCVLDMKAMDSKSNGAIAWSNQTS

FTCQDIFKETNATYPSSDVPCDATLTEKSFETDMNLNFQNLLVIVLRILLL

KVAGFNLLMTLRLWSSRAKRSGSGATNFSLLKQAGDVEENPGPMHTRLLFW

VAFCLLGADHTGAGVSQSPSNKVTEKGKDVELRCDPISGHTALYWRQSLG

QGLEFLIYFQGNSAPDKSGLPSDRFSAERTGGSVSTLTIQRTQQEDSAVYL

CASTWDRGSYNEQFFGPGTRLTVLEDLRNVTPPKVSLFEPSKAEIANKQKA

TLVCLARGFFPDHVELSWWVNGKEVHSGVCTDPQAYKESNYSYCLSSRLRV

SATFWHNPRNHFRCQVQFHGLSEEDKWPEGSPKPVTQNISAEAWGRADCGI

TSASYQQGVLSATILYEILLGKATLYAVLVSTLVVMAMVKRKNS

The statistics for TCR 4238-F17-TCR3 for Patient 4238 are set forth in Table 16 below.

TABLE 16

| Parameter | # | Frequency |
|---|---|---|
| Total wells | 96 | 100% |
| CDR3alpha | 2 | 2.1% |
| CDR3beta | 2 | 2.1% |
| 4238-F17-TCR3 pairs | 2 | 2.1% |
| Total paired TCRs | 6 | 6.3% |

Example 4

This example demonstrates the isolation of two anti-mutated p53 TCRs from patient 4253.

Figure 16:
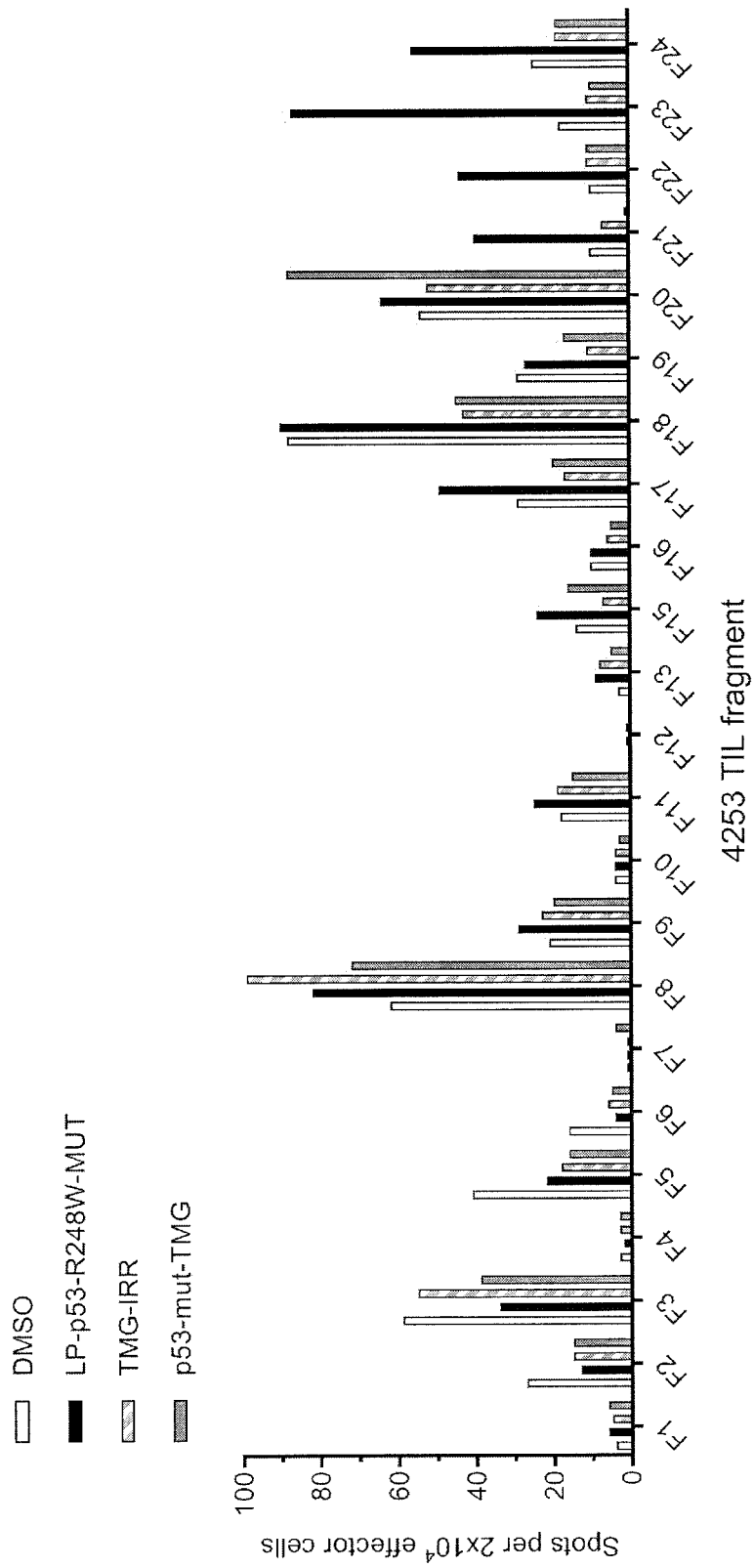
FIG. 16 is a graph showing the number of IFN-γ-positive spots per $2 \times 10^4$ effector cells measured following co-culture of TIL fragments (F1-F24; n=24) from patient 4253 with autologous APCs (1) pulsed with peptide vehicle (DMSO; open bars), (2) pulsed with purified (>95% by HPLC) 25-amino acid peptides composed of mutated p53-R248W (LP-p53-R248W-MUT; black bars) sequence, (3) electroporated with an irrelevant TMG (TMG-IRR; gray hatched bars), or (4) electroporated with p53-mut-TMG containing mutated p53-R248W sequence.

An experiment was carried out as described for FIG. 16 for Patient 4253.

TIL fragments (F1-F24; n=24) from patient 4253 were co-cultured with autologous APCs (1) pulsed with peptide vehicle (DMSO), (2) pulsed with purified (>95% by HPLC) 25-amino acid peptides composed of mutated p53-R248W sequence, (3) electroporated with an irrelevant TMG or (4) electroporated with p53-mut-TMG containing the mutated p53-R248W sequence. Co-cultures were performed overnight at 37° C. Secretion of IFN-γ was evaluated by ELISPOT. The results are shown in FIG. 16. F15 was selected for sorting for TCRs because it was reactive to both p53-mut-TMG and p53-R248W long peptide.

The sequence of TCR 4253-TIL-TCR1, which was isolated from Patient 4253, is set forth below. Starting from the amino terminus, the first underlined region is the CDR1alpha (SEQ ID NO: 187), the second underlined region is the CDR2alpha (SEQ ID NO: 188), the third underlined region is the CDR3alpha (SEQ ID NO: 189), the fourth underlined region is the CDR1beta (SEQ ID NO: 190), the fifth underlined region is the CDR2beta (SEQ ID NO: 191), and the sixth underlined region is the CDR3beta (SEQ ID NO: 192). The bold region is the linker (SEQ ID NO: 26). Starting from the amino terminus, the first italicized region is the alpha chain constant region (SEQ ID NO: 23) and the second italicized region is the beta chain constant region (SEQ ID NO: 25). The alpha chain variable region (SEQ ID NO: 193) includes the sequence starting from the amino terminus and ending immediately prior to the start of the alpha chain constant region. The beta chain variable region (SEQ ID NO: 194) includes the sequence starting immediately after the linker and ending immediately prior to the start of the beta chain constant region. The full-length alpha chain (SEQ ID NO: 195) includes the sequence starting from the amino terminus and ending immediately prior to the start of the linker. The full-length beta chain (SEQ ID NO: 196) includes the sequence starting immediately after the linker and ending with the carboxyl terminus.

Cancer reactive T cells were identified using the screening method set forth below. The method used to isolate the TCR is set forth below.

TCR name: 4253-TIL-TCR1
Recognition of p53 mutation: R248W
Method: Abbreviated p53 "hotspot" mutation universal screening (only mutated TMG and R248W long peptide evaluated)
Co-culture to identify TCR: Co-culture 4253-F15 with p53-R248W long peptide, sorted CD3+41BB+ T cells
Method to identify TCR: single-cell RT-PCR
Abundance of TCR amongst all paired TCRs: 5.6% (observed 2 times of 36 pairs)
TCR orientation: alpha-beta
Expression vector: SB transposon (SEQ ID NO: 561)
MAKCPQALLAIFWLLLSWVSSEDKVVQSPLSLVVHEGDTVTLNCSYEVTNF

RSLLWYKQEKKAPTFLFMLTSSGIEKKSGRLSSILDKKELSSILNITATQT

GDSAIYLCAGQNYGGSQGNLIFGKGTKLSVKPNIQNPEPAVYQLKDPRSQD

STLCLFTDFDSQINVPKTMESGTFITDKCVLDMKAMDSKSNGAIAWSNQTS

FTCQDIFKETNATYPSSDVPCDATLTEKSFETDMNLNFQNLLVIVLRILLL

KVAGFNLLMTLRLWSSRAKRSGSGATNFSLLKQAGDVEENPGPMHTWLVCW

AIFSLLKAGLTEPEVTQTPSHQVTQMGQEVILRCVPISNHLYFYWYRQILG

QKVEFLVSFYNNEISEKSEIFDDQFSVERPDGSNFTLKIRSTKLEDSAMYF

CASRDPAYEQYFGPGTRLTVTEDLRNVTPPKVSLFEPSKAEIANKQKATLV

CLARGFFPDHVELSWWVNGKEVHSGVCTDPQAYKESNYSYCLSSRLRVSAT

FWHNPRNHFRCQVQFHGLSEEDKWPEGSPKPVTQNISAEAWGRADCGITSA

SYQQGVLSATILYEILLGKATLYAVLVSTLVVMAMVKRKNS

The statistics for TCR 4253-TIL-TCR1 for Patient 4253 are set forth in Table 17 below.

TABLE 17

| Parameter | # | Frequency |
| --- | --- | --- |
| Total wells | 55 | 100% |
| CDR3alpha | 3 | 5.5% |
| CDR3beta | 2 | 3.6% |
| 4253-TIL-TCR1 pairs | 2 | 3.6% |
| Total paired TCRs | 36 | 65.5% |

The sequence of TCR 4253-TIL-TCR2, which was isolated from Patient 4253, is set forth below. Starting from the amino terminus, the first underlined region is the CDR1alpha (SEQ ID NO: 197), the second underlined region is the CDR2alpha (SEQ ID NO: 198), the third underlined region is the CDR3alpha (SEQ ID NO: 199), the fourth underlined region is the CDR1beta (SEQ ID NO: 200), the fifth underlined region is the CDR2beta (SEQ ID NO: 201), and the sixth underlined region is the CDR3beta (SEQ ID NO: 202). The bold region is the linker (SEQ ID NO: 26). Starting from the amino terminus, the first italicized region is the alpha chain constant region (SEQ ID NO: 23) and the second italicized region is the beta chain constant region (SEQ ID NO: 25). The alpha chain variable region (SEQ ID NO: 203) includes the sequence starting from the amino terminus and ending immediately prior to the start of the alpha chain constant region. The beta chain variable region (SEQ ID NO: 204) includes the sequence starting immediately after the linker and ending immediately prior to the start of the beta chain constant region. The full-length alpha chain (SEQ ID NO: 205) includes the sequence starting from the amino terminus and ending immediately prior to the start of the linker. The full-length beta chain (SEQ ID NO: 206) includes the sequence starting immediately after the linker and ending with the carboxyl terminus.

Cancer reactive T cells were identified using the screening method set forth below. The method used to isolate the TCR is set forth below.

TCR name: 4253-TIL-TCR2
Recognition of p53 mutation: R248W
Method: Abbreviated p53 "hotspot" mutation universal screening (only mutated TMG and R248W long peptide evaluated)
Co-culture to identify TCR: Co-culture 4253-F15 with p53-R248W long peptide, sorted CD3+41BB+ T cells
Method to identify TCR: single-cell RT-PCR
Abundance of TCR amongst all paired TCRs: 91.7% (observed 33 times of 36 pairs)

TCR orientation: alpha-beta
Expression vector: SB transposon (SEQ ID NO: 562)
MASLRVLLVILWLQLSWVWSQQKEVEQNSGPLSVPEGAIASLNCTYSDRGS

QSFFWYRQYSGKSPELIMF_IYSNGD_KEDGRFTAQLNKASQYVSLLIRDSQP

SDSATYLCAVNPPVKTSYDKVIFGPGTSLSVIP_NIQNPEPAVYQLKDPRSQ_

_DSTLCLFTDFDSQINVPKTMESGTFITDKCVLDMKAMDSKSNGAIAWSNQT_

_SFTCQDIFKETNATYPSSDVPCDATLTEKSFETDMNLNFQNLLVIVLRILL_

_LKVAGFNLLMTLRLWSS_RAKRSGSGATNFSLLKQAGDVEENPGPMHTSLLC

WVVLGFLGTDHTGAGVSQSPRYKVTKRGQDVALRCDPI_SGHVS_LYWYRQAL

GQGPEFLTY_FNYEAQQ_DKSGLPNDRFSAERPEGSISTLTIQRTEQRDSAMY

RCASSHREPHTGELFFGEGSRLTV_LEDLRNVTPPKVSLFEPSKAEIANKQK_

_ATLVCLARGFFPDHVELSWWVNGKEVHSGVCTDPQAYKESNYSYCLSSRLR_

_VSATFWHNPRNHFRCQVQFHGLSEEDKWPEGSPKPVTQNISAEAWGRADCG_

_ITSASYQQGVLSATILYEILLGKATLYAVLVSTLVVMAMVKRKNS_

The statistics for TCR 4253-TIL-TCR2 for Patient 4253 are set forth in Table 18 below.

TABLE 18

| Parameter | # | Frequency |
|---|---|---|
| Total wells | 55 | 100% |
| CDR3alpha | 35 | 63.6% |
| CDR3beta | 33 | 60.0% |
| 4253-TIL-TCR2 pairs | 33 | 60.0% |
| Total paired TCRs | 36 | 65.5% |

Example 5

This example demonstrates the identification of anti-mutated p53 T cells in Patient 4273 by co-culturing autologous APCs induced to express mutated p53 within autologous T cells ("p53 hotspot mutation universal screening"). This example also demonstrates the isolation of two anti-mutated p53 TCRs from patient 4273.

Experiments were carried out as described for FIGS. 17-20 and 56-60 for Patient 4273.

Figure 17:
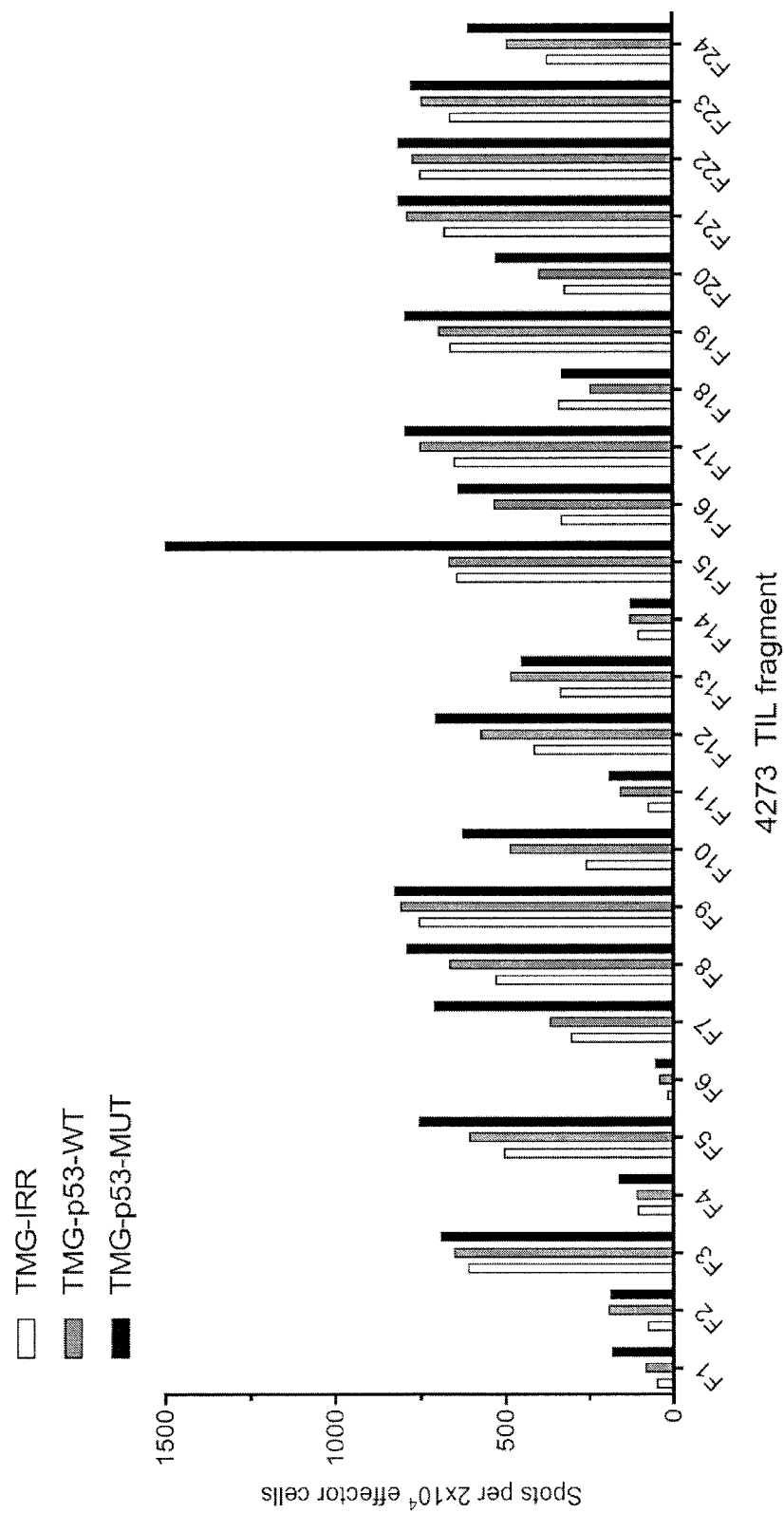
FIG. 17 is a graph showing the number of IFN-γ-positive spots per $2 \times 10^4$ effector cells measured following co-culture of TIL fragments (F1-F24, n=24) from patient 4273 with autologous APCs electroporated with TMG (TMG) composed of irrelevant (IRR; open bars) WT p53 (p53-WT; gray bars) or mutated p53 (p53-MUT; black bars) sequence.
Figure 18:
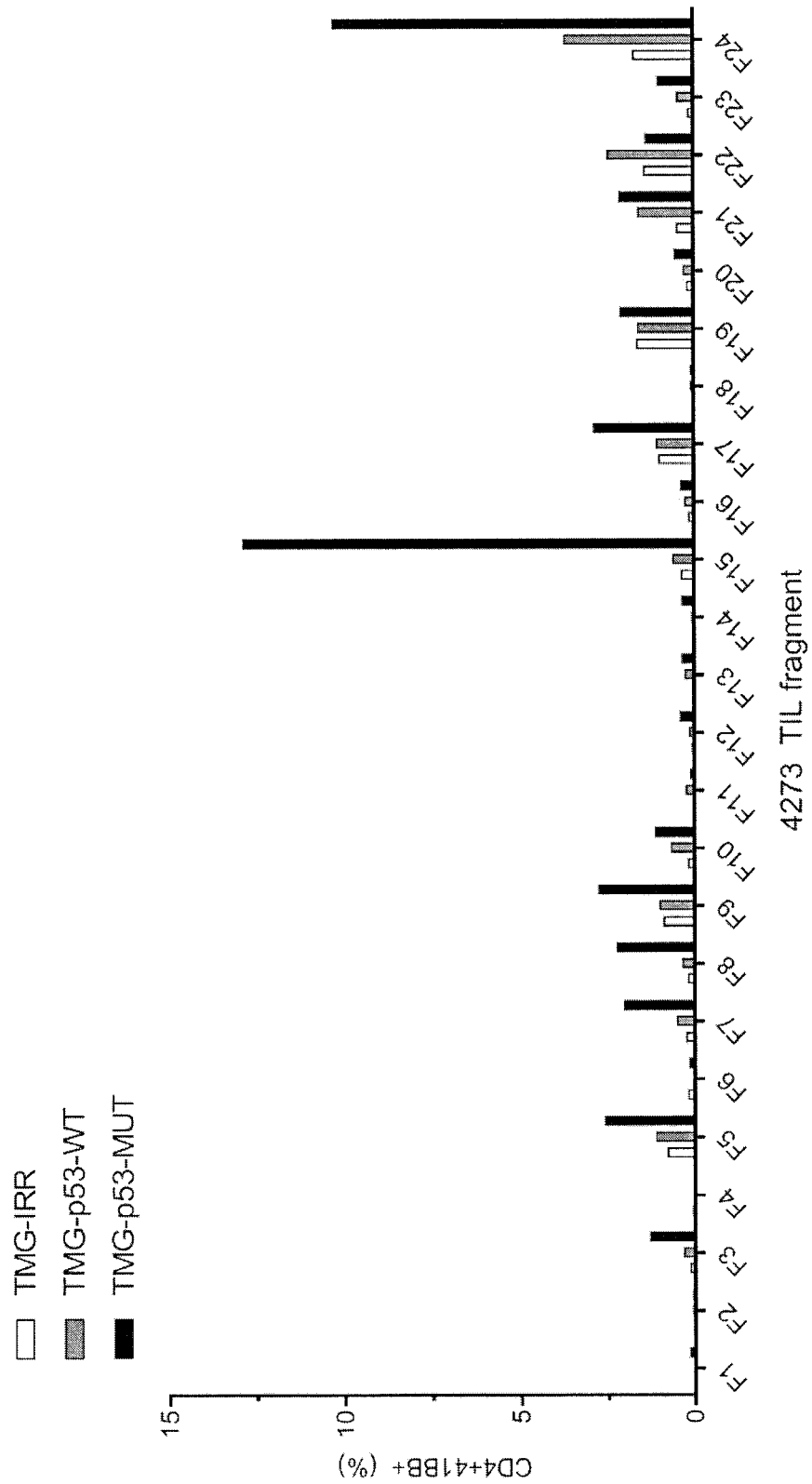
FIG. 18 is a graph showing the percentage of CD4+4-1BB+ cells detected following co-culture of patient 4273 TIL fragments F1-F24 (n=24) with autologous APCs electroporated with TMG composed of irrelevant (IRR; open bars) WT p53 (p53-WT; gray bars) or mutated p53 (p53-MUT; black bars) sequence.

TIL fragments (F1-F24, n=24) from patient 4273 were co-cultured with autologous APCs electroporated with TMG composed of irrelevant, WT p53 or mutated p53 sequence. Co-cultures were performed overnight at 37° C. Secretion of IFN-γ was evaluated using ELISPOT assay. The results are shown in FIG. 17. Expression of 4-1BB was evaluated by flow cytometry after gating for lymphocytes→living cells (PI negative)→CD3+ (T cells). The results are shown in FIG. 18.

Figure 19:
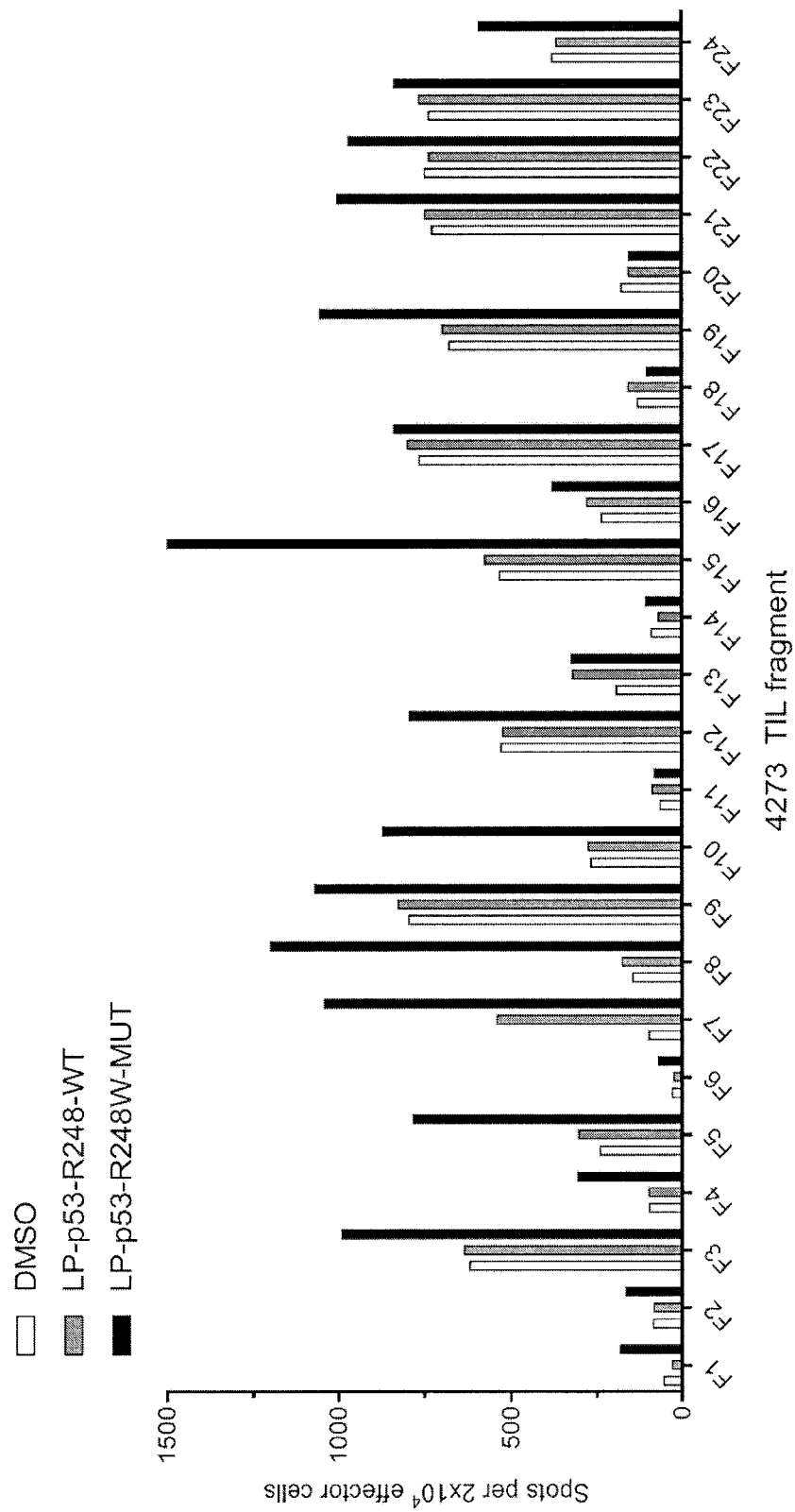
FIG. 19 is a graph showing the number of IFN-γ-positive spots per $2 \times 10^4$ effector cells measured following co-culture of TIL fragments (F1-F24, n=24) from patient 4273 with autologous APCs pulsed with peptide vehicle (DMSO; open bars) or purified (>95% by HPLC) 25-amino acid peptides composed of WT p53-R248 sequence (LP-p53-R248-WT; gray bars) or mutated p53-R248W (LP-p53-R248W-MUT; black bars) sequence.
Figure 20:
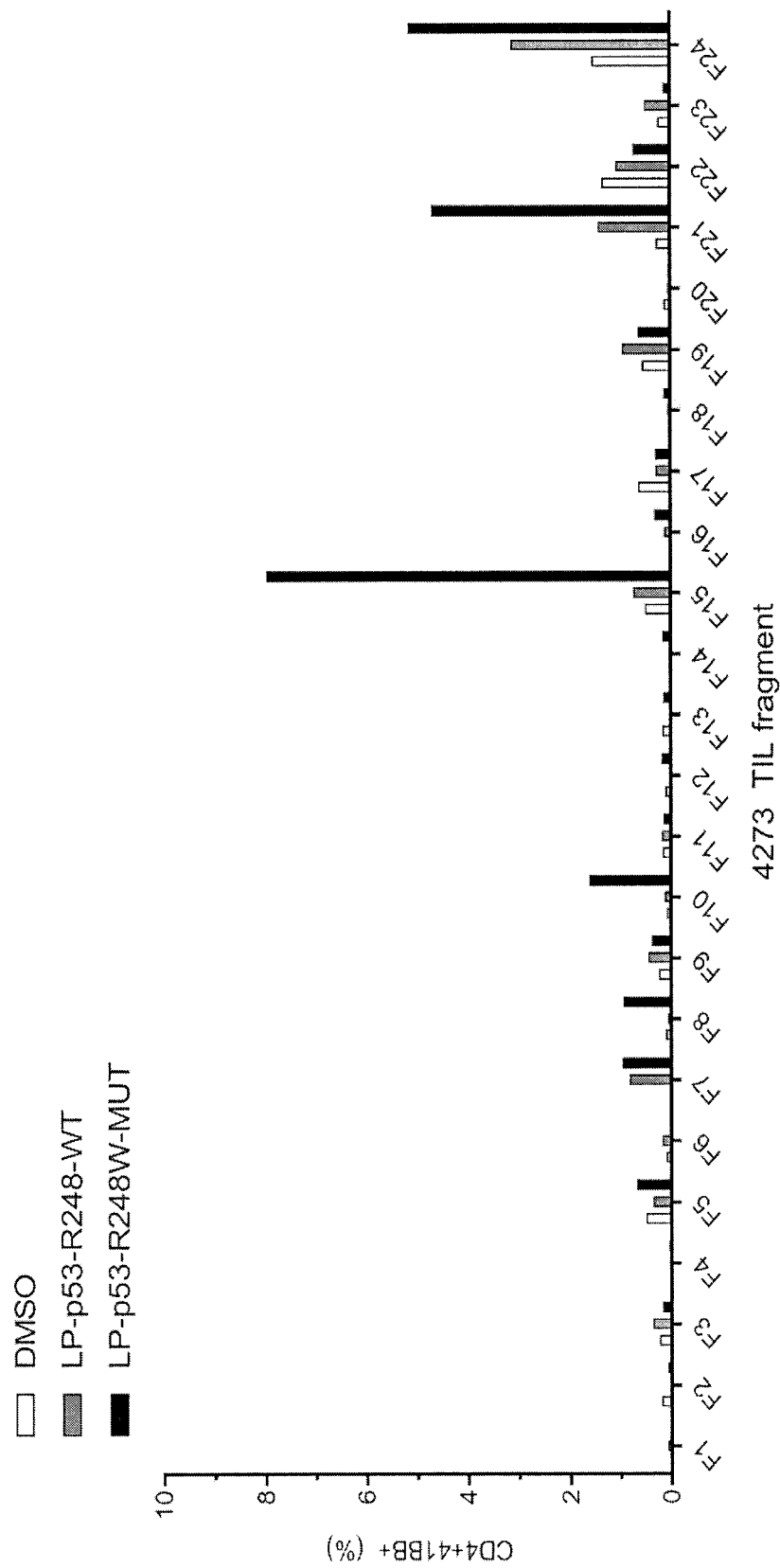
FIG. 20 is a graph showing the percentage of CD4+4-1BB+ cells detected following co-culture of TIL fragments (F1-F24, n=24) from patient 4273 with autologous APCs pulsed with peptide vehicle (DMSO; open bars) or purified (>95% by HPLC) 25-amino acid peptides composed of WT p53-R248 sequence (LP-p53-R248-WT; gray bars) or mutated p53-R248W (LP-p53-R248W-MUT; black bars) sequence.

TIL fragments (F1-F24, n=24) from patient 4273 were co-cultured with autologous APCs pulsed with peptide vehicle (DMSO) or purified (>95% by HPLC) 25-amino acid peptides composed of WT p53-R248 sequence or mutated p53-R248W sequence. Co-cultures were performed overnight at 37° C. Secretion of IFN-γ was evaluated using ELISPOT assay. The results are shown in FIG. 19. Expression of 4-1BB was evaluated by flow cytometry after gating for lymphocytes→living cells (PI negative)→CD3+ (T cells). The results are shown in FIG. 20.

For patient 4273, F15 was the most reactive fragment and the responses by F15 to the LP and TMG were comparable and primarily by CD4 T cells. So 4273-F15 was co-cultured with APCs pulsed with the R248W LP, and the following day CD4+41BB+ T cells were sorted as single cells into to the wells of a 96 well PCR plate at one cell per well. The PCR plate has an RT-PCR solution in each well, which amplifies the TCR alpha and beta CDR3 regions in the same solution. The wells of the plate are then split into two 96 well PCR plates and a second PCR round is performed to amplify either the CDR3 alpha or the CDR3 beta as separate reactions. The PCR products from each well (total of 192 PCR products mapped to each well—alpha or beta) are sequenced by Sanger sequencing. The nucleotide sequence is inputted into IMGT/V-QUEST (imgt.org/IMGT_vquest/vquest?livret=0&Option=humanTcR), IgBlast (ncbi.nlm.nih.gov/igblast/igblast.cgi?CMD=Web&SEARCH_TYPE=TCR&LINK_LOC=igtab) and translated by Expasy (web.expasy.org/translate/). The variable family is determined and fused to the CDR3 and junction (J or DJ) from the translated sequence. The variable sequence is fused to the murine constant sequence and the reconstructed TCRalpha and TCRbeta are linked by furin-felxible-P2A (RAKR-SGSG-ATNFSLLKQAGDVEENPGP) (SEQ ID NO: 26). Then the sequence is synthesized into DNA de novo and cloned into an expression vector (gamma-retrovirus or SLEEPING BEAUTY (SB) transposon (University of Minnesota, Minneapolis, MN)). T cells are then made to express the TCR using the standard viral transduction or non-viral transposition protocols and T cells expressing murinized TCRs (as detected by mouse TCR beta constant chain) are tested against the putative peptide.

Autologous APCs were transfected with TMG encoding irrelevant mutations, WT p53 sequences or mutated p53 sequences including p53-R248W. Media alone and PMA and Ionomycin were negative and positive controls, respectively. TIL from patient 4273 (fragment cultures 8 and 15) were co-cultured overnight at 37° C. with TMG transfected APCs. Expression of 4-1BB was evaluated by flow cytometry after gating for lymphocytes→living cells (PI negative)→CD3+ (T cells). The results are shown in FIG. 56.

Autologous APCs were pulsed with 25 amino acid peptides corresponding to the WT or mutated p53-R248W neoepitope for 2 hours at 37° C. TIL from patient 4273 (fragment culture 15) with specificity to p53-R248W were co-cultured overnight at 37° C. with peptide-pulsed APCs. DMSO was peptide vehicle. Expression of 4-1BB was evaluated by flow cytometry after gating for lymphocytes→living cells (PI negative)→CD3+ (T cells). The results are shown in FIG. 57.

Autologous APCs were pulsed with 15 amino acid peptides from the p53-R248W neoepitope overlapping 14 amino acids. TIL from patient 4273 (fragment culture 15) with specificity to p53-R248W were co-cultured overnight at 37° C. with peptide-pulsed APCs. DMSO was peptide vehicle, media alone (T cells only) and PMA and ionomycin were controls. The 25 amino acid peptides (wt p53-R248 and mutated p53-R248W) were additional controls for the 15 amino acid peptides. Expression of 4-1 BB was evaluated by flow cytometry after gating for lymphocytes→living cells (PI negative)→CD3+ (T cells)→CD4+CD8−. The results are shown in FIG. 58.

Cos 7 cells (2.5×10$^4$ per well) were plated on wells of flat-bottom 96 well plates. The following day, cells were co-transfected with individual HLA alleles from patient 4273 and either wild type or mutated TP53 TMG with or without the p53-R248W neoantigen, respectively. The following day, TIL with specificity to p53-R248W from Patient 4273 (fragment culture 15) were co-cultured with transfected Cos 7 cells overnight at 37° C. Secretion of IFN-γ was evaluated by ELISA. The results are shown in FIG. 59.

T cells expressing mock (no TCR) or 4273-TCR1a2 were co-cultured with autologous APCs which were pulsed with peptide vehicle (DMSO) or purified (>95% by HPLC) 25 amino acid peptides composed of wild type p53-R248 sequence or mutated p53-R248W sequences. Media alone and PMA and Ionomycin were negative and positive controls, respectively. Co-cultures were performed overnight at 37° C. Secretion of IFN-γ was evaluated by ELISPOT. The results are shown in FIG. 60.

The sequence of TCR 4273-TP53-R248W-TCR1a1, which was isolated from Patient 4273, is set forth below. Starting from the amino terminus, the first underlined region is the CDR1alpha (SEQ ID NO: 437), the second underlined region is the CDR2alpha (SEQ ID NO: 438), the third underlined region is the CDR3alpha (SEQ ID NO: 439), the fourth underlined region is the CDR1beta (SEQ ID NO: 440), the fifth underlined region is the CDR2beta (SEQ ID NO: 441), and the sixth underlined region is the CDR3beta (SEQ ID NO: 442). The bold region is the linker (SEQ ID NO: 26). Starting from the amino terminus, the first italicized region is the alpha chain constant region (SEQ ID NO: 23) and the second italicized region is the beta chain constant region (SEQ ID NO: 25). The alpha chain variable region (SEQ ID NO: 443) includes the sequence starting from the amino terminus and ending immediately prior to the start of the alpha chain constant region. The beta chain variable region (SEQ ID NO: 444) includes the sequence starting immediately after the linker and ending immediately prior to the start of the beta chain constant region. The full-length alpha chain (SEQ ID NO: 445) includes the sequence starting from the amino terminus and ending immediately prior to the start of the linker. The full-length beta chain (SEQ ID NO: 446) includes the sequence starting immediately after the linker and ending with the carboxyl terminus.

TCR name: 4273-TP53-R248W-TCR1a1
Recognition of p53 mutation: R248W
Method: p53 "hotspot" mutation universal screening (SEQ ID NO: 563)
MASLRVLLVILWLQLSWVWSQQKEVEQNSGPLSVPEGAIASLNCTYS<u>DRGS</u>

<u>Q</u>SFFWYRQYSGKSPELIMF<u>IYSNGD</u>KEDGRFTAQLNKASQYVSLLIRDSQP

SDSATYLC<u>AVTLCGGYNKLI</u>FGAGTRLAVHP*NIQNPEPAVYQLKDPRSQDS*

*TLCLFTDFDSQINVPKTMESGTFITDKCVLDMKAMDSKSNGAIAWSNQTSF*

*TCQDIFKETNATYPSSDVPCDATLTEKSFETDMNLNFQNLLVIVLRILLLK*

*VAGFNLLMTLRLWSS*RAKRSGSGATNFSLLKQAGDVEENPGPMHNQVLCCV

VLCFLGANTVDGGITQSPKYLFRKEGQNVTLSCEQN<u>LNHDAMYWYRQDPGQ</u>

GLRLIYY<u>SQIVND</u>FQKGDIVEGYSVSREKKESFPLTVTSAQKNPTAFYLC<u>A</u>

<u>SSSRDYEQYF</u>GPGTRLTVT*EDLRNVTPPKVSLFEPSKAEIANKQKATLVCL*

*ARGFFPDHVELSWWVNGKEVHSGVCTDPQAYKESNYSYCLSSRLRVSATFW*

*HNPRNHFRCQVQFHGLSEEDKWPEGSPKPVTQNISAEAWGRADCGITSASY*

*QQGVLSATILYEILLGKATLYAVLVSTLVVMAMVKRKNS*

The sequence of TCR 4273-TP53-R248W-TCR1a2, which was isolated from Patient 4273, is set forth below. Starting from the amino terminus, the first underlined region is the CDR1alpha (SEQ ID NO: 447), the second underlined region is the CDR2alpha (SEQ ID NO: 448), the third underlined region is the CDR3alpha (SEQ ID NO: 449), the fourth underlined region is the CDR1 beta (SEQ ID NO: 450), the fifth underlined region is the CDR2beta (SEQ ID NO: 451), and the sixth underlined region is the CDR3beta (SEQ ID NO: 452). The bold region is the linker (SEQ ID NO: 26). Starting from the amino terminus, the first italicized region is the alpha chain constant region (SEQ ID NO: 23) and the second italicized region is the beta chain constant region (SEQ ID NO: 25). The alpha chain variable region (SEQ ID NO: 453) includes the sequence starting from the amino terminus and ending immediately prior to the start of the alpha chain constant region. The beta chain variable region (SEQ ID NO: 454) includes the sequence starting immediately after the linker and ending immediately prior to the start of the beta chain constant region. The full-length alpha chain (SEQ ID NO: 455) includes the sequence starting from the amino terminus and ending immediately prior to the start of the linker. The full-length beta chain (SEQ ID NO: 456) includes the sequence starting immediately after the linker and ending with the carboxyl terminus.

TCR name: 4273-TP53-R248W-TCR1a2
Recognition of p53 mutation: R248W
Method: p53 "hotspot" mutation universal screening (SEQ ID NO: 564)
MASLRVLLVILWLQLSWVWSQQKEVEQNSGPLSVPEGAIASLNCTYS<u>DRGS</u>

<u>Q</u>SFFWYRQYSGKSPELIMF<u>IYSNGD</u>KEDGRFTAQLNKASQYVSLLIRDSQP

SDSATYLC<u>AVTLSGGYNKLI</u>FGAGTRLAVHP*NIQNPEPAVYQLKDPRSQDS*

*TLCLFTDFDSQINVPKTMESGTFITDKCVLDMKAMDSKSNGAIAWSNQTSF*

*TCQDIFKETNATYPSSDVPCDATLTEKSFETDMNLNFQNLLVIVLRILLLK*

*VAGFNLLMTLRLWSS*RAKRSGSGATNFSLLKQAGDVEENPGPMHNQVLCCV

VLCFLGANTVDGGITQSPKYLFRKEGQNVTLSCEQN<u>LNHDAMYWYRQDPGQ</u>

GLRLIYY<u>SQIVND</u>FQKGDIVEGYSVSREKKESFPLTVTSAQKNPTAFYLC<u>A</u>

<u>SSSRDYEQYF</u>GPGTRLTVT*EDLRNVTPPKVSLFEPSKAEIANKQKATLVCL*

*ARGFFPDHVELSWWVNGKEVHSGVCTDPQAYKESNYSYCLSSRLRVSATFW*

*HNPRNHFRCQVQFHGLSEEDKWPEGSPKPVTQNISAEAWGRADCGITSASY*

*QQGVLSATILYEILLGKATLYAVLVSTLVVMAMVKRKNS*

The statistics for the TCRs of Patient 4273 are set forth in Table 19 below. In Table 19, 96 total wells sorted with 41BB+ T cells after co-culture with mutated p53 protein (TMG or peptide). 77 wells had productive pairs (meaning had (1) a sequence and (2) no stop codons in the sequence) for a pairing frequency of 80.2%. 43 of those pairs were the CDR3A/CDR3B combination to make 4273-TP53-R248W-TCR1a1 (55.8% of the productive pairs). 30 of those pairs were the CDR3A/CDR3B combination to make 4273-TP53-R248W-TCR1a2 (39% of the productive pairs). Overall, the CDR3A and CDR3B for 4273-TP53-R248W-TCR1a1 were found 50 and 83 times, respectively, out of 96 wells. Overall, the CDR3A and CDR3B for 4273-TP53-R248W-TCR1a2 were found 33 and 83 times, respectively, out of 96 wells.

TABLE 19

| TCR name | 4273-TP53-R248W-TCR1a1 | 4273-TP53-R248W-TCR1a2 |
|---|---|---|
| CDR3a | CAVTLCGGYNKLIF (SEQ ID NO: 439) | CAVTLSGGYNKLIF (SEQ ID NO: 449) |
| CDR3b | CASSSRDYEQYF (SEQ ID NO: 442) | CASSSRDYEQYF (SEQ ID NO: 452) |
| total wells | 96 | |
| total CDR3a/CDR3b pairs | 77 | |
| % paired | 80.21% | |
| # times CDR3a | 50 | 33 |
| # times CDR3b | 83 | 83 |
| paired CDR3a/CDR3b | 43 | 30 |
| % of paired CDR3a/CDR3b pairs | 55.84% | 38.96% |

Example 6

This example demonstrates the identification of anti-mutated p53 T cells in Patient 4149. This example also demonstrates the isolation and specific reactivity of one anti-mutated p53 TCR from patient 4149.

Experiments were carried out as described for FIGS. 21-24 for Patient 4149. The TCR was found using the Tran method. The TCR was then used to validate the "p53 hotspot mutation universal screening" method.

Figure 21:
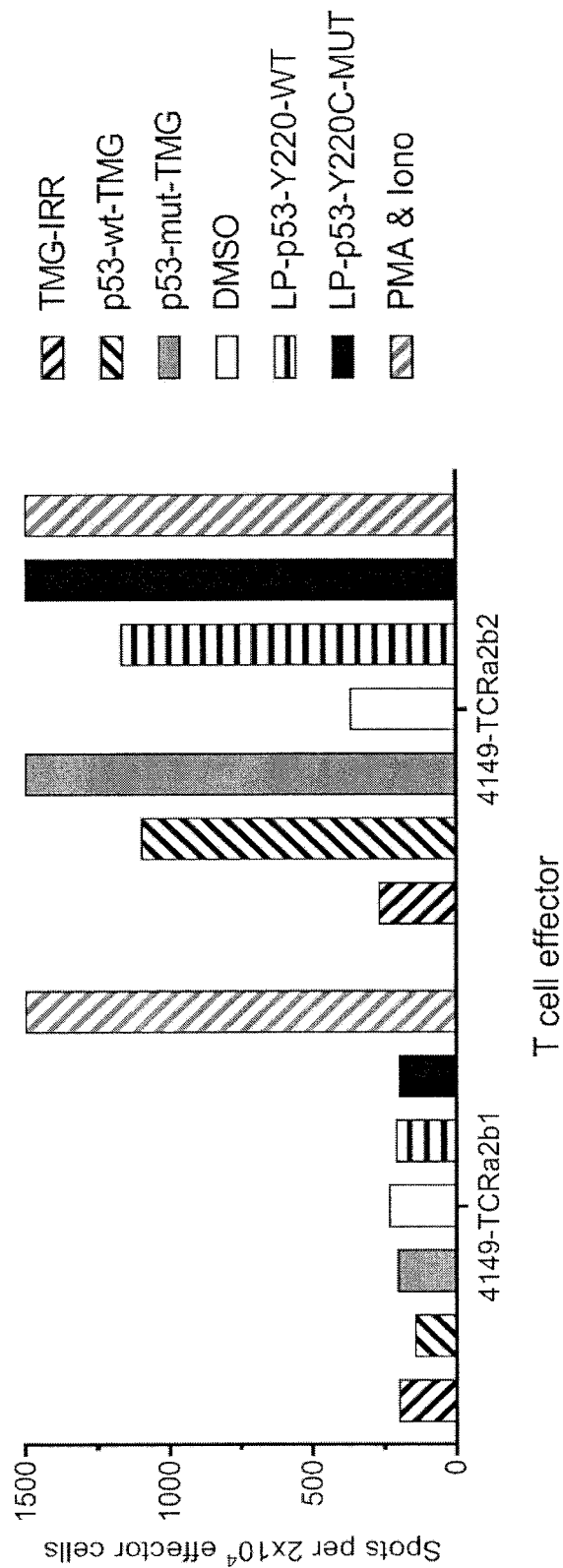
FIG. 21 is a graph showing the number of IFN-γ-positive spots per $2 \times 10^4$ effector cells measured following co-culture of autologous PBL from patient 4149 (transposed with 4149-TCRa2b1 or 4149-TCRa2b2) with autologous APCs which were (1) electroporated with TMG composed of irrelevant (IRR; right hatched black bars), WT p53 (p53-wt-TMG; left hatched black bars) or mutated p53 (p53-mut-TMG; gray bars) sequence or (2) pulsed with peptide vehicle (DMSO; open bars) or purified (>95% by HPLC) 25-amino acid peptides composed of WT p53-Y220 sequence (LP-p53-Y220-WT; horizontal hatched black bars) or mutated p53-Y220C (LP-p53-Y220C-MUT; black bars) sequence. Phorbol 12-myristate 13-acetate (PMA) and Ionomycin (Iono) was positive control (gray bars).
Figure 22:
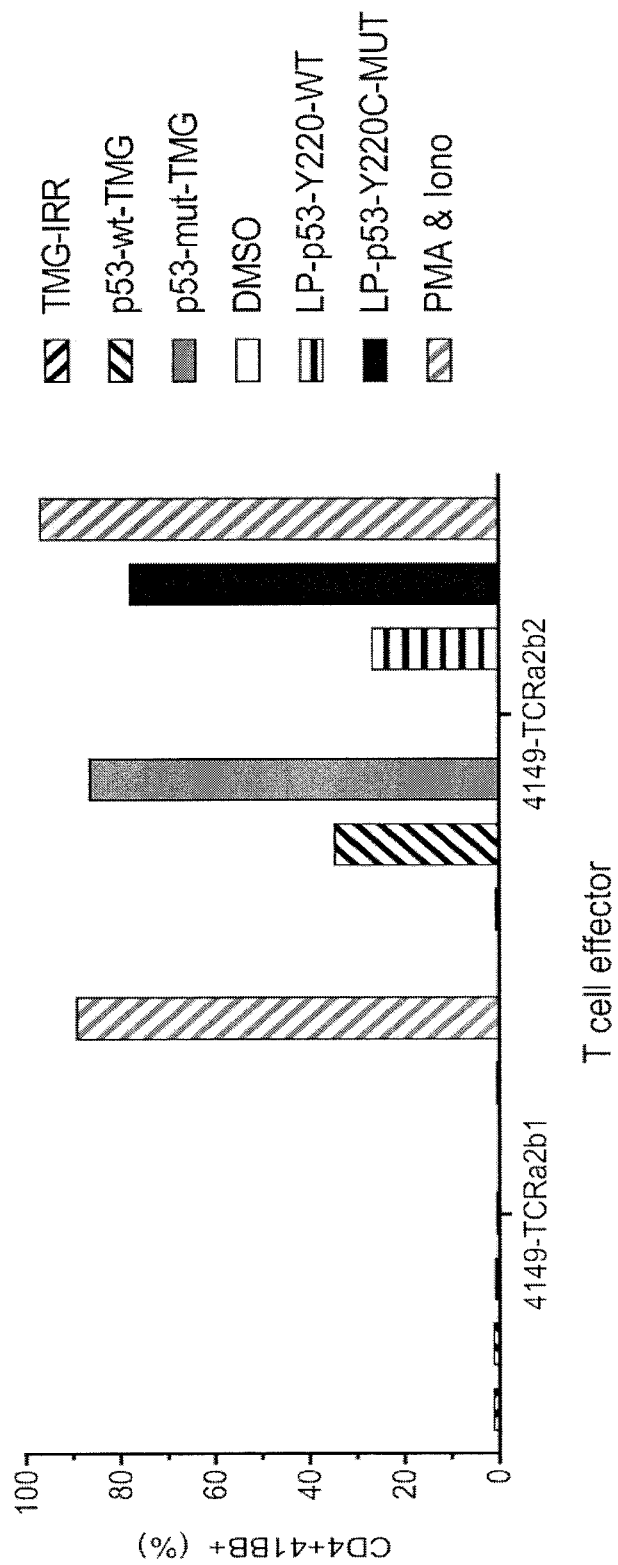
FIG. 22 is a graph showing the percentage of CD4+4-1BB+ cells detected following co-culture of autologous PBL from patient 4149 that were transposed with a TCR (4149-TCRa2b1 or 4149-TCRa2b2) with autologous APCs which were (1) electroporated with TMG composed of irrelevant (IRR; right hatched black bars), WT p53 (p53-wt-TMG; left hatched black bars), or mutated p53 (p53-mut-TMG; gray bars) sequence or (2) pulsed with peptide vehicle (DMSO; open bars) or purified (>95% by HPLC) 25-amino acid peptides composed of WT p53-Y220 sequence (LP-p53-Y220-WT; horizontal hatched black bars) or mutated p53-Y220C (LP-p53-Y220C-MUT; black bars) sequence. PMA and Iono was positive control (gray bars).

A TCR (4149-TCRa2b1 or 4149-TCRa2b2) was transposed into autologous PBL from patient 4149 and co-cultured with autologous APCs which were (1) electroporated with TMG composed of irrelevant, WT p53, or mutated p53 sequence or (2) pulsed with peptide vehicle (DMSO) or purified (>95% by HPLC) 25-amino acid peptides composed of WT p53-Y220 sequence or mutated p53-Y220C sequence. Combination of PMA and ionomycin was positive control. Co-cultures were performed overnight at 37° C. Secretion of IFN-γ was evaluated using ELISPOT assay. The results are shown in FIG. 21. Expression of 4-1 BB was evaluated by flow cytometry after gating for lymphocytes→living cells (PI negative)→CD3+ (T cells)→CD4+ mTCR+ (TCR transposed T cells). The results are shown in FIG. 22.

The percentage of CD4+4-1BB+ cells by TCRAD deep sequencing and TCRB deep sequencing was also performed. The results are shown in Table E.

TABLE E

| TCR name | % of CD4+ 41BB+ by TCRAD deep sequencing | % of CD4+ 41BB+ by TCRB deep sequencing |
|---|---|---|
| 4149-TCR-a2b1 | 20% | 66% |
| 4149-TCR-a2b2 | 20% | 18% |

Figure 23:
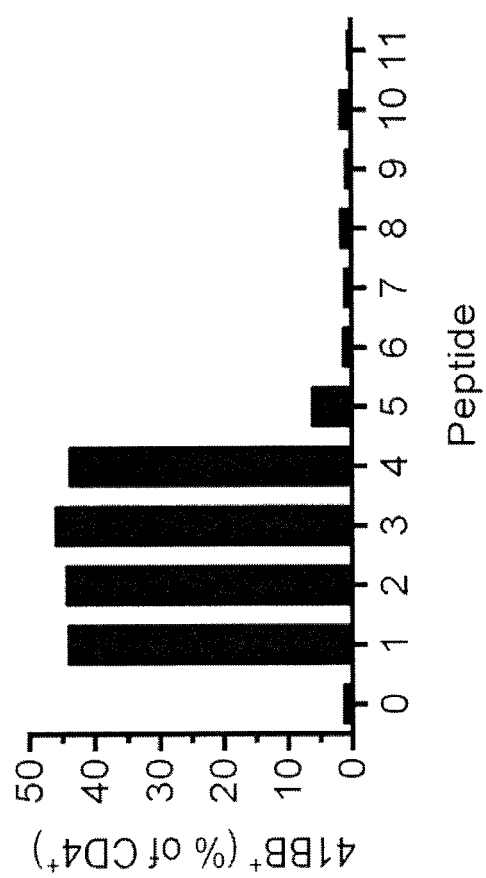
FIG. 23 is a graph showing the percentage of 4-1BB+ cells (% of CD4+ T cells) detected following co-culture of TIL from patient 4149 with autologous DCs pulsed with one of the peptides of Table F.

Mapping of putative p53$^{Y220C}$ minimal epitope recognized by 4149-F11: Autologous DC cells were peptide pulsed (10 μg/mL) and rested overnight in granulocyte-macrophage colony-stimulating factor (GM-CSF) and IL-4. TIL were rested for 2-3 days in 500 CU/mL IL-2. 2×10⁴ TIL and 10⁵ target cells were co-cultured overnight at 37° C. IFN-γ was measured by ELISPOT. The results are shown in Table F. 4-1BB expression was measured by FACS with the gate lymphocytes\PI(neg)CD3+\CD3+CD4+. The results are shown in FIG. 23.

TABLE F

| Peptide No. | ELISPOT Result Positive (+) or negative (-) for IFN-γ production | Peptide | SEQ ID NO: |
|---|---|---|---|
| 0 | - | Vehicle | Not applicable |
| 1 | + | DRNTFRHSVVVPCEP | 508 |
| 2 | + | RNTFRHSVVVPCEPP | 509 |
| 3 | + | NTFRHSVVVPCEPPE | 510 |
| 4 | + | TFRHSVVVPCEPPEV | 511 |
| 5 | +(weak) | FRHSVVVPCEPPEVG | 512 |
| 6 | - | RHSVVVPCEPPEVGS | 513 |
| 7 | - | HSVVVPCEPPEVGSD | 514 |
| 8 | - | SVVVPCEPPEVGSDC | 515 |
| 9 | - | VVVPCEPPEVGSDCT | 516 |
| 10 | - | VVPCEPPEVGSDCTT | 517 |
| 11 | - | VPCEPPEVGSDCTTI | 518 |

Figure 24:
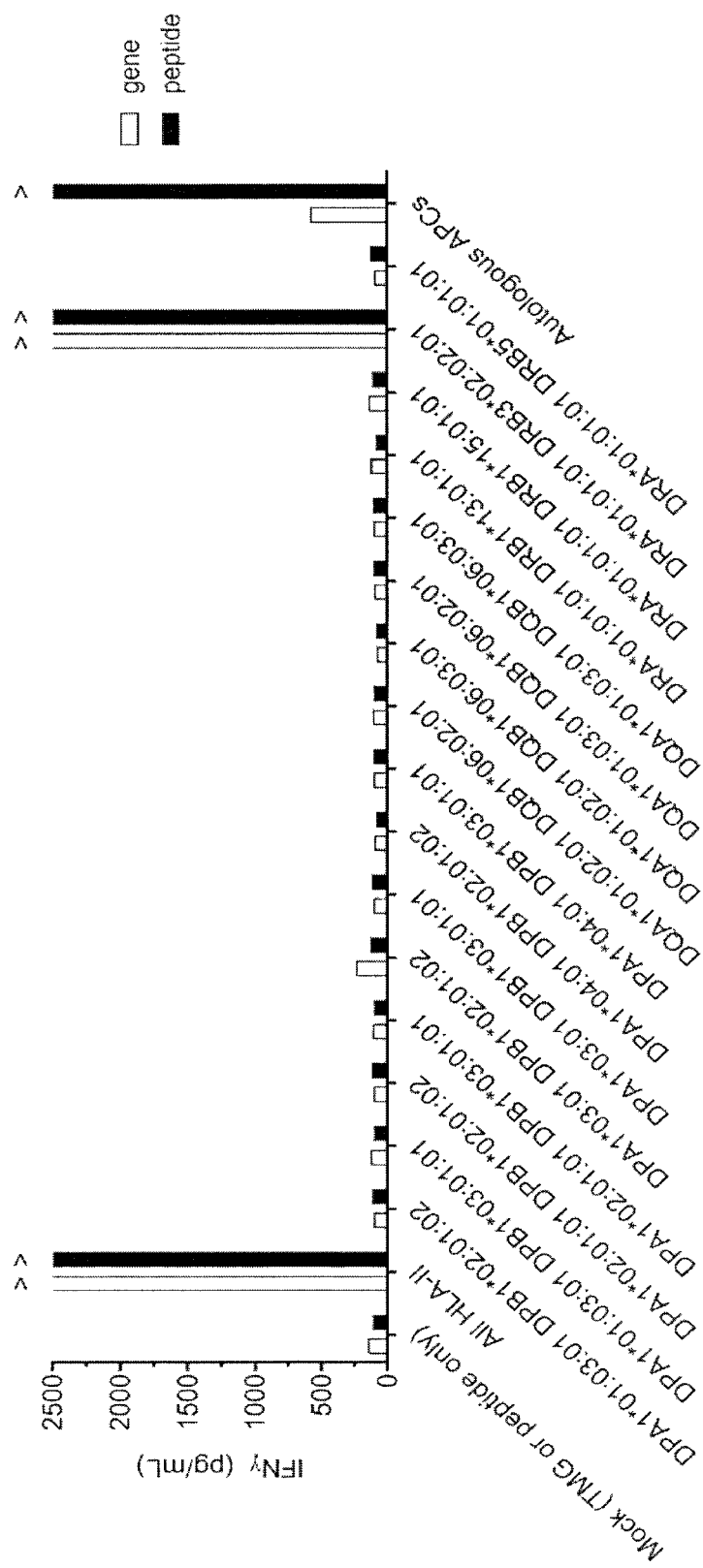
FIG. 24 is a graph showing IFN-γ secretion (pg/mL) following co-culture of 4149-TCRa2b2 transposed T cells with Cos 7 cells co-transfected with individual HLA alleles+/−TMGs. Cells not transfected with TMG were pulsed with p53Y220C 15-mer peptide. Pulsed target cells are indicated by shaded bars. Target cells transfected with TMG are indicated by unshaded bars.

Cos 7 cells (2.5×10⁴ per well) were plated on wells of flat-bottom 96 well plates. After 20 hours, cells were co-transfected with individual HLA alleles with or without TMGs. After 20 hours, autologous DC cells were transfected with TMG in parallel. All HLA Class-II alleles were co-transfected into one set of wells with or without TMG. Cells not transfected with TMG were pulsed with p53-Y220C 15-mer peptide for 2-3 hours at 37° C. at 10 μg/mL. After washing, 4149-TCRa2b2-transposed T cells (10⁵) at day+14 of second REP were added to wells and co-cultured overnight at 37° C. IFN-γ secretion was measured by ELISA. The results are shown in FIG. 24. Prediction (Table G) by NetMHCIIpan: cbs.dtu.dk/services/NetMHCIIpan/.

TABLE G

| HLA | Peptide | Affinity, nM | Rank |
|---|---|---|---|
| DRB3*02:02 | NTFRHSVVVPCEPPE (SEQ ID NO: 510) | 433.8 | 17 |

DRB3*02 expression was detected in 1367 of 3719 (37%) of DRB_typed patients in the NCI HLA database and in 5 of 9 (56%) endometrial and ovarian cancer patients at NCI-SB. The reported frequency of the DRB3*02 allele is very high, as described in Example 1.

The sequence of TCR 4149TCRa2b2, which was isolated from Patient 4149, is set forth below. Starting from the amino terminus, the first underlined region is the CDR1alpha (SEQ ID NO: 57), the second underlined region is the CDR2alpha (SEQ ID NO: 58), the third underlined region is the CDR3alpha (SEQ ID NO: 59), the fourth underlined region is the CDR1beta (SEQ ID NO: 60), the fifth underlined region is the CDR2beta (SEQ ID NO: 61), and the sixth underlined region is the CDR3beta (SEQ ID NO: 62). The bold region is the linker (SEQ ID NO: 26). Starting from the amino terminus, the first italicized region is the alpha chain constant region (SEQ ID NO: 23) and the second italicized region is the beta chain constant region (SEQ ID NO: 25). The alpha chain variable region (SEQ ID NO: 63) includes the sequence starting from the amino terminus and ending immediately prior to the start of the alpha chain constant region. The beta chain variable region (SEQ ID NO: 64) includes the sequence starting immediately after the linker and ending immediately prior to the start of the beta chain constant region. The full-length alpha chain (SEQ ID NO: 65) includes the sequence starting from the amino terminus and ending immediately prior to the start of the linker. The full-length beta chain (SEQ ID NO: 66) includes the sequence starting immediately after the linker and ending with the carboxyl terminus.

Cancer reactive T cells were identified using the screening method set forth below. The p53 reactive cells for this patient were identified by the Transcreening method as described in U.S. Application No. 2017/0224800.
- TCR name: 4149TCRa2b2
- Recognition of p53 mutation: Y220C
- Screening method: Used to validate the p53 "hotspot" mutation universal screening
- Co-culture to identify TCR: Co-culture 4149-F11 TIL fragment with p53-Y220C long peptide, sorted CD4+ 41BB+ T cells
- Method to identify TCR: Frequency pairing. CD4+ 41BB+ sorted T cells were expanded in REP (rapid expansion protocol) and the resulting T cell culture was subjected to TCRAD (alpha) and TCRB (beta) deep sequencing by Adaptive Biotechnologies. The top two TCR alphas were paired with the top two TCR betas in a matrix of 4 total TCRs. The second TCR alpha and second TCR beta was the reactive TCR hence TCRa2b2 nomenclature.
- Abundance of TCR amongst all TCRs: as below
- TCR orientation: alpha-beta
- Expression vector: SB transposon (SEQ ID NO: 565)
MASAPISMLAMLFTLSGLRAQSVAQPEDQVNVAEGNPLTVKCTYSVSGNP

YLFWYVQYPNRGLQFLLKYITGDNLVKGSYGFEAEFNKSQTSFHLKKPSA

LVSDSALYFCAVRVWDYKLSFGAGTTVTVRANIQNPEPAVYQLKDPRSQD

STLCLFTDFDSQINVPKTMESGTFITDKCVLDMKAMDSKSNGAIAWSNQT

SFTCQDIFKETNATYPSSDVPCDATLTEKSFETDMNLNFQNLLVIVLRIL

LLKVAGFNLLMTLRLWSSRAKRSGSGATNFSLLKQAGDVEENPGPMHNQV

LCCVVLCFLGANTVDGGITQSPKYLFRKEGQNVTLSCEQNLNHDAMYWYR

QDPGQGLRLIYYSQIVNDFQKGDIAEGYSVSREKKESFPLTVTSAQKNPT

AFYLCASSISAGGDGYTFGSGTRLTVVEDLRNVTPPKVSLFEPSKAEIAN

KQKATLVCLARGFFPDHVELSWWVNGKEVHSGVCTDPQAYKESNYSYCLS

SRLRVSATFWHNPRNIIFRCQVQFHGLSEEDKWPEGSPKPVTQNISAEAW

GRADCGITSASYQQGVLSATILYEILLGKATLYAVLVSTLVVMAMVKRKNS

The statistics for TCR 4149TCRa2b2 of Patient 4149 are set forth in Table 20 below.

TABLE 20

| CDR3 | Rank of unique, productive CDR3s | CDR3 Counts | CDR3 Frequency |
|---|---|---|---|
| Alpha: CAVRVWDYKLSF (SEQ ID NO: 59) | 2 of 4,308 | 648,707 of 3,309,400 | 19.6% |

TABLE 20-continued

| CDR3 | Rank of unique, productive CDR3s | CDR3 Counts | CDR3 Frequency |
|---|---|---|---|
| Beta: CASSISAGGDGYTF (SEQ ID NO: 62) | 2 of 3,176 | 104,325 of 578,948 | 18.0% |

Example 7

This example demonstrates the identification of anti-mutated p53 T cells in Patient 4213 by co-culturing autologous APCs induced to express mutated p53 within autologous T cells ("p53 hotspot mutation universal screening"). This example also demonstrates the isolation of twelve anti-mutated p53 TCRs from patient 4213.

Figure 25:
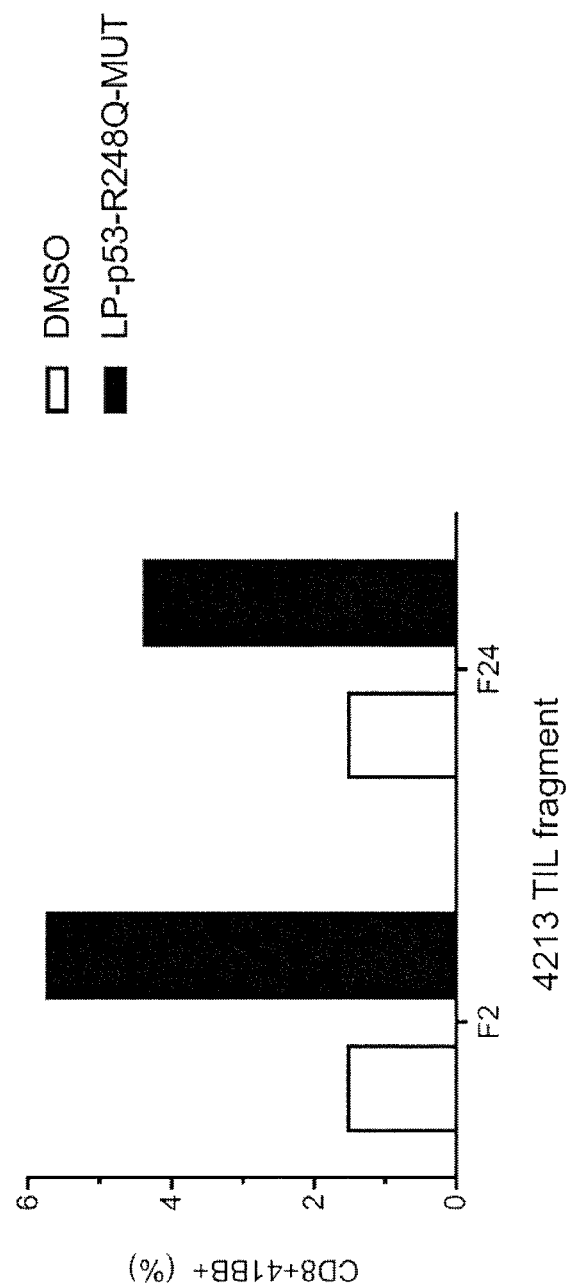
FIG. 25 is a graph showing the percentage of CD8+4-1BB+ cells detected following co-culture of TIL fragments (F2 and F24) from patient 4213 with autologous APCs pulsed with peptide vehicle (DMSO; open bars) or purified (>95% by HPLC) 25-amino acid peptides composed of the mutated p53-R248Q (LP-p53-R248Q-MUT; black bars) sequence.
Figure 26:
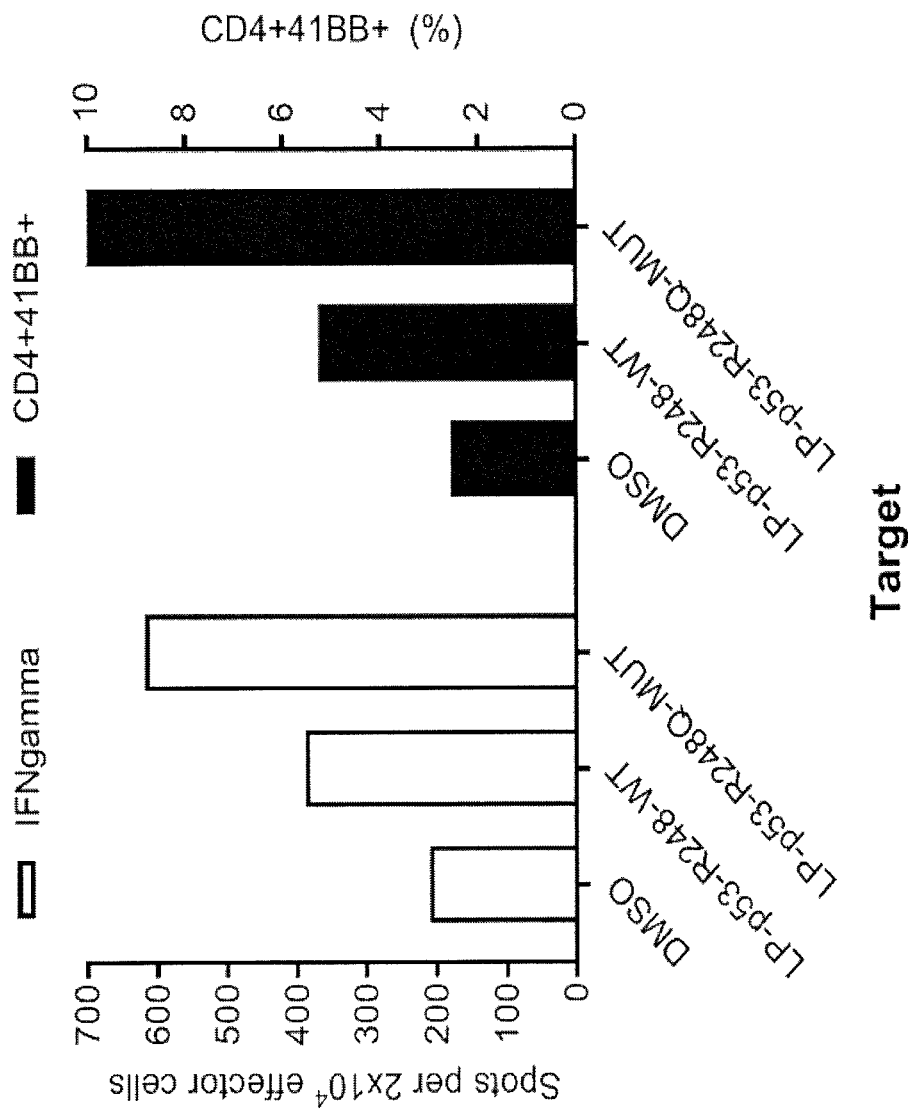
FIG. 26 is a graph showing the number of IFN-γ-positive spots per $2 \times 10^4$ effector cells measured following co-culture of CD4+ T cells from patient 4213 with autologous APCs pulsed with peptide vehicle (DMSO; open bars) or purified (>95% by HPLC) 25-amino acid peptides composed of the mutated p53-R248Q (LP-p53-R248Q-MUT; black bars)

Experiments were carried out as described for FIGS. 25-26 for Patient 4213.

TIL fragments (F2 and F24) from patient 4213 were co-cultured with autologous APCs pulsed with peptide vehicle (DMSO) or purified (>95% by HPLC) 25-amino acid peptides composed of the mutated p53-R248Q sequence. Co-cultures were performed overnight at 37° C. Expression of 4-1BB was evaluated by flow cytometry after gating for lymphocytes→living cells (PI negative)→CD3+ (T cells). The results are shown in FIG. 25. CD8+4-1BB+ T cells were sorted into wells of 96 wells plates. TCRs were identified using single-cell RT-PCR.

CD4+ T cells came from patient 4213's peripheral blood lymphocytes. The CD4+ T cell culture was co-cultured with autologous APCs pulsed with peptide vehicle (DMSO) or purified (>95% by HPLC) 25-amino acid peptides composed of the mutated p53-R248Q sequence. Co-cultures were performed overnight at 37° C. Secretion of IFN-γ was evaluated by ELISPOT. Expression of 4-1BB was evaluated by flow cytometry after gating for lymphocytes→living cells (PI negative)→CD3+ (T cells). The results are shown in FIG. 26. CD4+41BB+ T cells were sorted into wells of 96 wells plates. TCRs were identified using single-cell RT-PCR.

The sequence of 4213-F2-TCR1, which was isolated from Patient 4213, is set forth below. Starting from the amino terminus, the first underlined region is the CDR1alpha (SEQ ID NO: 317), the second underlined region is the CDR2alpha (SEQ ID NO: 318), the third underlined region is the CDR3alpha (SEQ ID NO: 319), the fourth underlined region is the CDR1beta (SEQ ID NO: 320), the fifth underlined region is the CDR2beta (SEQ ID NO: 321), and the sixth underlined region is the CDR3beta (SEQ ID NO: 322). The bold region is the linker (SEQ ID NO: 26). Starting from the amino terminus, the first italicized region is the alpha chain constant region (SEQ ID NO: 23) and the second italicized region is the beta chain constant region (SEQ ID NO: 25). The alpha chain variable region (SEQ ID NO: 323) includes the sequence starting from the amino terminus and ending immediately prior to the start of the alpha chain constant region. The beta chain variable region (SEQ ID NO: 324) includes the sequence starting immediately after the linker and ending immediately prior to the start of the beta chain constant region. The full-length alpha chain (SEQ ID NO: 325) includes the sequence starting from the amino terminus and ending immediately prior to the start of the linker. The full-length beta chain (SEQ ID NO: 326) includes the sequence starting immediately after the linker and ending with the carboxyl terminus.

Cancer reactive T cells were identified using the screening method set forth below. The method used to isolate the TCR is set forth below.

TCR name: 4213-F2-TCR1
Recognition of p53 mutation: R248Q
Screening method: p53 "hotspot" mutation universal screening
Co-culture to identify TCR: Co-culture 4213-F2 with R248Q long peptide, sorted CD8+41BB+ T cells
Method to identify TCR: single-cell RT-PCR
Abundance of TCR amongst all paired TCRs: 8.3% (observed 2 times of 24 pairs)
TCR orientation: alpha-beta
Expression vector: SB transposon (SEQ ID NO: 566)
MAMLLGASVLILWLQPDWVNSQQKNDDQQVKQNSPSLSVQEGRISILNCD

YTNSMFDYFLWYKKYPAEGPTFLISISSIKDKNEDGRFTVFLNKSAKHLS

LHIVPSQPGDSAVYFCAANTGNQFYFGTGTSLTVIPNIQNPEPAVYQLKD

PRSQDSTLCLFTDFDSQINVPKTMESGIFITDKCVLDMKAMDSKSNGAMW

SNQTSFTCQDIFKETNATYPSSDVPCDATLTEKSFETDMNLNFQNLLVIV

LRILLLKVAGENLLMTLRLWSSRAKRSGSGATNFSLLKQAGDVEENPGPM

HTRLLCWAALCLLGAELTEAGVAQSPRYKIIEKRQSVAFWCNPISGHATL

YWYQQILGQGPKLLIQFQNNGVVDDSQLPKDRFSAERLKGVDSTLKIQPA

KLEDSAVYLCASSHLAGEFYNEQFFGPGTRLTVLEDLRNVTPPKVSLFEP

SKAEIANKQKATLVCLARGEFPDHVELSWWVNGKEVHSGVCTDPQAYKES

NYSYCLSSRLRVSATEWHNPRNHERCQVQFHGLSEEDKWPEGSPKPVTQN

ISAEAWGRADCGITSASYQQGVLSATILYEILLGKATLYAVLVSTLVVMA

MVKRKNS

The statistics for TCR 4213-F2-TCR1 of Patient 4213 are set forth in Table 21 below.

TABLE 21

| Parameter | # | Frequency |
|---|---|---|
| Total wells | 96 | 100% |
| CDR3alpha | 3 | 3.1% |
| CDR3beta | 8 | 8.3% |
| 4213-F2-TCR1 pairs | 2 | 2.1% |
| Total paired TCRs | 24 | 25.0% |

The sequence of 4213-F2-TCR2, which was isolated from Patient 4213, is set forth below. Starting from the amino terminus, the first underlined region is the CDR1alpha (SEQ ID NO: 327), the second underlined region is the CDR2alpha (SEQ ID NO: 328), the third underlined region is the CDR3alpha (SEQ ID NO: 329), the fourth underlined region is the CDR1beta (SEQ ID NO: 330), the fifth underlined region is the CDR2beta (SEQ ID NO: 331), and the sixth underlined region is the CDR3beta (SEQ ID NO: 332). The bold region is the linker (SEQ ID NO: 26). Starting from the amino terminus, the first italicized region is the alpha chain constant region (SEQ ID NO: 23) and the second italicized region is the beta chain constant region (SEQ ID NO: 25). The alpha chain variable region (SEQ ID NO: 333) includes the sequence starting from the amino terminus and ending immediately prior to the start of the alpha chain constant region. The beta chain variable region (SEQ ID NO: 334) includes the sequence starting immediately after the linker and ending immediately prior to the start of the beta chain constant region. The full-length alpha chain (SEQ ID NO: 335) includes the sequence starting from the amino terminus and ending immediately prior to the start of the linker. The full-length beta chain (SEQ ID NO: 336) includes the sequence starting immediately after the linker and ending with the carboxyl terminus.

Cancer reactive T cells were identified using the screening method set forth below. The method used to isolate the TCR is set forth below.

TCR name: 4213-F2-TCR2
Recognition of p53 mutation: R248Q
Screening method: p53 "hotspot" mutation universal screening
Co-culture to identify TCR: Co-culture 4213-F2 with R248Q long peptide, sorted CD8+41BB+ T cells
Method to identify TCR: single-cell RT-PCR
Abundance of TCR amongst all paired TCRs: 12.5% (observed 3 times of 24 pairs)
TCR orientation: alpha-beta
Expression vector: SB transposon (SEQ ID NO: 567)
MAGAFLLYVSMKMGGTAGQSLEQPSEVTAVEGAIVQINCTYQTSGFYGLS

WYQQHDGGAPTFLSYNALDGLEETGRFSSFLSRSDSYGYLLLQELQMKDS

ASYFCAFAYGQNFVFGPGTRLSVLPNIQNPEPAVYQLKDPRSQDSTLCLF

TDFDSQINVPKTMESGTFITDKCVLDMKAMDSKSNGAIAWSNQTSFTCQD

IFKETNATYPSSDVPCDATLTEKSFETDMNLNFQNLLVIVLRILLLKVAG

FNLLMTLRLWSSRAKRSGSGATNFSLLKQAGDVEENPGPMHFRLLCCVAF

CLLGAGPVDSGVTQTPKHLITATGQRVTLRCSPRSGDLSVYWYQQSLDQG

LQFLIQYYNGEERAKGNILERFSAQQFPDLHSELNLSSLELGDSALYFCA

SSPLGDSGNTIYFGEGSWLTVVEDLRNVTPPKVSLFEPSKAEIANKQKAT

LVCLARGFFPDHVELSWWVNGKEVHSGVCTDPQAYKESNYSYCLSSRLRV

SATFWHNPRNHFRCQVQFHGLSEEDKWPEGSPKPVTQNISAEAWGRADCG

ITSASYQQGVLSATILYEILLGKATLYAVLVSTLVVMAMVKRKNS

The statistics for TCR 4213-F2-TCR2 of Patient 4213 are set forth in Table 22 below.

TABLE 22

| Parameter | # | Frequency |
|---|---|---|
| Total wells | 96 | 100% |
| CDR3alpha | 4 | 4.2% |
| CDR3beta | 4 | 4.2% |
| 4213-F2-TCR2 pairs | 3 | 3.1% |
| Total paired TCRs | 24 | 25.0% |

The sequence of 4213-F2-TCR3, which was isolated from Patient 4213, is set forth below. Starting from the amino terminus, the first underlined region is the CDR1alpha (SEQ ID NO: 337), the second underlined region is the CDR2alpha (SEQ ID NO: 338), the third underlined region is the CDR3alpha (SEQ ID NO: 339), the fourth underlined region is the CDR1 beta (SEQ ID NO: 340), the fifth underlined region is the CDR2beta (SEQ ID NO: 341), and the sixth underlined region is the CDR3beta (SEQ ID NO: 342). The bold region is the linker (SEQ ID NO: 26). Starting from the amino terminus, the first italicized region is the alpha chain constant region (SEQ ID NO: 23) and the second italicized region is the beta chain constant region (SEQ ID NO: 25). The alpha chain variable region (SEQ ID NO: 343) includes the sequence starting from the amino terminus and ending immediately prior to the start of the alpha chain constant region. The beta chain variable region (SEQ ID NO: 344) includes the sequence starting immediately after the linker and ending immediately prior to the start of the beta chain constant region. The full-length alpha chain (SEQ ID NO: 345) includes the sequence starting from the amino terminus and ending immediately prior to the start of the linker. The full-length beta chain (SEQ ID NO: 346) includes the sequence starting immediately after the linker and ending with the carboxyl terminus.

Cancer reactive T cells were identified using the screening method set forth below. The method used to isolate the TCR is set forth below.

TCR name: 4213-F2-TCR3
Recognition of p53 mutation: R248Q
Screening method: p53 "hotspot" mutation universal screening
Co-culture to identify TCR: Co-culture 4213-F2 with R248Q long peptide, sorted CD8+41BB+ T cells
Method to identify TCR: single-cell RT-PCR
Abundance of TCR amongst all paired TCRs: 70.8% (observed 17 times of 24 pairs)
TCR orientation: alpha-beta
Expression vector: SB transposon (SEQ ID NO: 568)
MATLLGVSLVILWLQLARVNSQQGEEDPQALSIQEGENATMNCSYKTSIN
NLQWYRQNSGRGLVHLILIRSNEREKHSGRLRVTLDTSKKSSSLLITASR
AADTASYFCATDAWNNDMRFGAGTRLTVKP*NIQNPEPAVYQLKDPRSQDS*
*TLCLFIDEDSQINVPKTMESGTFITDKCVLDMKAMDSKSNGAMWSNQTSF*
*TCQDIFKETNATYPSSDVPCDATLTEKSFETDMNLNFQNLLVIVLRILLL*
*KVAGINLLMTLRLWSS*RAKRSGSGATNFSLLKQAGDVEENPGP*MHIGLLC*
*CVAFSLLWASPVNAGVTQTPKFQVLKTGQSMTLQCAQD*MNHNSMYWYRQD
PGMGLRLIYSASEGTTDKGEVPNGYNVSRLNKREFSLRLESAAPSQTSV
YFCASSESQGNTEAFFGQGTRLTVV*EDLRNVTPPKVSLEEPSKAEIANKQ*
*KATLVCLARGFFPDHVELSWWVNGKEVHSGVCTDPQAYKESNYSYCLSSR*
*LRVSATEWHNPRNIIFRCQVQFIIGLSEEDKWPEGSPKPVTQNISAEAWG*
*RADCGITSASYQQGVLSATILYEILLGKATLYAVLVSTLVVMAMVKRKNS*

The statistics for TCR 4213-F2-TCR3 of Patient 4213 are set forth in Table 23 below.

TABLE 23

| Parameter | # | Frequency |
|---|---|---|
| Total wells | 96 | 100% |
| CDR3alpha | 19 | 19.8% |
| CDR3beta | 42 | 43.8% |
| 4213-F2-TCR3 pairs | 17 | 17.7% |
| Total paired TCRs | 24 | 25.0% |

The sequence of 4213-F24-TCRa1, which was isolated from Patient 4213, is set forth below. Starting from the amino terminus, the first underlined region is the CDR1alpha (SEQ ID NO: 347), the second underlined region is the CDR2alpha (SEQ ID NO: 348), the third underlined region is the CDR3alpha (SEQ ID NO: 349), the fourth underlined region is the CDR1beta (SEQ ID NO: 350), the fifth underlined region is the CDR2beta (SEQ ID NO: 351), and the sixth underlined region is the CDR3beta (SEQ ID NO: 352). The bold region is the linker (SEQ ID NO: 26). Starting from the amino terminus, the first italicized region is the alpha chain constant region (SEQ ID NO: 23) and the second italicized region is the beta chain constant region (SEQ ID NO: 25). The alpha chain variable region (SEQ ID NO: 353) includes the sequence starting from the amino terminus and ending immediately prior to the start of the alpha chain constant region. The beta chain variable region (SEQ ID NO: 354) includes the sequence starting immediately after the linker and ending immediately prior to the start of the beta chain constant region. The full-length alpha chain (SEQ ID NO: 355) includes the sequence starting from the amino terminus and ending immediately prior to the start of the linker. The full-length beta chain (SEQ ID NO: 356) includes the sequence starting immediately after the linker and ending with the carboxyl terminus.

Cancer reactive T cells were identified using the screening method set forth below. The method used to isolate the TCR is set forth below.

TCR name: 4213-F24-TCRa1
Recognition of p53 mutation: R248Q
Screening method: p53 "hotspot" mutation universal screening
Co-culture to identify TCR: Co-culture 4213-F24 with R248Q long peptide, sorted CD8+41BB+ T cells
Method to identify TCR: single-cell RT-PCR
Abundance of TCR amongst all paired TCRs: 15.9% (observed 7 times of 44 pairs)
TCR orientation: alpha-beta
Expression vector: SB transposon (SEQ ID NO: 569)
MAKHLTTFLVILWLYFYRGNGKNQVEQSPQSLIILEGKNCTLQCNYTVSPF
SNLRWYKQDTGRGPVSLTIMTFSENTKSNGRYTATLDADTKQSSLHITASQ
LSDSASYICVVSSYKIIEGTGTRLHVFP*NIQNPEPAVYQLKDPRSQDSTLC*
*LETDFDSQINVPKTMESGTFITDKCVLDMKAMDSKSNGAIAWSNQTSFTCQ*
*DIFKETNATYPSSDVPCDATLTEKSFETDMNLNFQNLLVIVLRILLLKVAG*
*ENLLMTLRLWSS*RAKRSGSGATNFSLLKQAGDVEENPGP*MHTRLLFWVAFC*
*LLGAYHTGAGVSQSPSNKVTEKGKDVELRCDP*ISGHTALYWYRQRLGQGLE
FLIYFQGNSAPDKSGLPSDRFSAERTGESVSTLTIORTQQEDSAVYLCASS
PIQGENSPLHFGNGTRLTVT*EDLRNVTPPKVSLFEPSKAEIANKQKATLVC*
*LARGFFPDHVELSWWVNGKEVHSGVCTDPQAYKESNYSYCLSSRLRVSATE*
*WHNPRNHFRCQVQFHGLSEEDKWPEGSPKPVTQNISAEAWGRADCGITSAS*
*YQQGVLSATILYEILLGKATLYAVLVSTLVVMAMVKRKNS*

The statistics for TCR 4213-F24-TCRa1 of Patient 4213 are set forth in Table 24 below.

TABLE 24

| Parameter | # | Frequency |
|---|---|---|
| Total wells | 96 | 100% |
| CDR3alpha | 7 | 7.3% |
| CDR3beta | 80 | 83.3% |

TABLE 24-continued

| Parameter | # | Frequency |
|---|---|---|
| 4213-F24-TCRa1 pairs | 7 | 7.3% |
| Total paired TCRs | 44 | 45.8% |

The sequence of 4213-F24-TCRa2, which was isolated from Patient 4213, is set forth below. Starting from the amino terminus, the first underlined region is the CDR1alpha (SEQ ID NO: 357), the second underlined region is the CDR2alpha (SEQ ID NO: 358), the third underlined region is the CDR3alpha (SEQ ID NO: 359), the fourth underlined region is the CDR1beta (SEQ ID NO: 360), the fifth underlined region is the CDR2beta (SEQ ID NO: 361), and the sixth underlined region is the CDR3beta (SEQ ID NO: 362). The bold region is the linker (SEQ ID NO: 26). Starting from the amino terminus, the first italicized region is the alpha chain constant region (SEQ ID NO: 23) and the second italicized region is the beta chain constant region (SEQ ID NO: 25). The alpha chain variable region (SEQ ID NO: 363) includes the sequence starting from the amino terminus and ending immediately prior to the start of the alpha chain constant region. The beta chain variable region (SEQ ID NO: 364) includes the sequence starting immediately after the linker and ending immediately prior to the start of the beta chain constant region. The full-length alpha chain (SEQ ID NO: 365) includes the sequence starting from the amino terminus and ending immediately prior to the start of the linker. The full-length beta chain (SEQ ID NO: 366) includes the sequence starting immediately after the linker and ending with the carboxyl terminus.

Cancer reactive T cells were identified using the screening method set forth below. The method used to isolate the TCR is set forth below.

TCR name: 4213-F24-TCRa2
   Recognition of p53 mutation: R248Q
   Screening method: p53 "hotspot" mutation universal screening
   Co-culture to identify TCR: Co-culture 4213-F24 with R248Q long peptide, sorted CD8+41BB+ T cells
   Method to identify TCR: single-cell RT-PCR
   Abundance of TCR amongst all paired TCRs: 84.1% (observed 37 times of 44 pairs)
   TCR orientation: alpha-beta
   Expression vector: SB transposon (SEQ ID NO: 570)
MAKHLTTFLVILWLYFYRGNGKNQVEQSPQSLIILEGKNCTLQCNYT<u>VSP
FSNLRWYKQDT</u>GRGPVSLT<u>IMTFSENT</u>KSNGRYTATLDADTKQSSLHITA
SQLSDSASY<u>ICVVSSYKLI</u>FGTGTRLQVFP*NIQNPEPAVYQLKDPRSQDS
TLCLFTDFDSQINVPKTMESGTFITDKCVLDMKAMDSKSNGAIAWSNQTS
FTCQDIFKETNATYPSSDVPCDATLTEKSFETDMNLNFQNLLVIVLRILL
LKVAGFNLLMTLRLWSS*RAKRSGSGATNFSLLKQAGDVEENPGP*MHTRLL
FWVAFCLLGAYHTGAGVSQSPSNKVTEKGKDVELRCDPI<u>SGHTALY</u>WYRQ
RLGQGLEFLIY<u>FQGNS</u>APDKSGLPSDRFSAERTGESVSTLTIQRTQQEDS
AVYLCASS<u>PIQGENSPLHF</u>GNGTRLTVT*EDLRNVTPPKVSLFEPSKAEIA
NKQKATLVCLARGFFPDHVELSWWVNGKEVHSGVCTDPQAYKESNYSYCL -continued
SSRLRVSATFWHNPRNHFRCQVQFHGLSEEDKWPEGSPKPVTQNISAEAW
GRADCGITSASYQQGVLSATILYEILLGKATLYAVLVSTLVVMAMVKRKN
S*

The statistics for TCR 4213-F24-TCRa2 of Patient 4213 are set forth in Table 25 below.

TABLE 25

| Parameter | # | Frequency |
|---|---|---|
| Total wells | 96 | 100% |
| CDR3alpha | 39 | 40.6% |
| CDR3beta | 80 | 83.3% |
| 4213-F24-TCRa2 pairs | 37 | 38.5% |
| Total paired TCRs | 44 | 45.8% |

The sequence of 4213-PBL-TCR1, which was isolated from Patient 4213, is set forth below. Starting from the amino terminus, the first underlined region is the CDR1alpha (SEQ ID NO: 367), the second underlined region is the CDR2alpha (SEQ ID NO: 368), the third underlined region is the CDR3alpha (SEQ ID NO: 369), the fourth underlined region is the CDR1beta (SEQ ID NO: 370), the fifth underlined region is the CDR2beta (SEQ ID NO: 371), and the sixth underlined region is the CDR3beta (SEQ ID NO: 372). The bold region is the linker (SEQ ID NO: 26). Starting from the amino terminus, the first italicized region is the alpha chain constant region (SEQ ID NO: 23) and the second italicized region is the beta chain constant region (SEQ ID NO: 25). The alpha chain variable region (SEQ ID NO: 373) includes the sequence starting from the amino terminus and ending immediately prior to the start of the alpha chain constant region. The beta chain variable region (SEQ ID NO: 374) includes the sequence starting immediately after the linker and ending immediately prior to the start of the beta chain constant region. The full-length alpha chain (SEQ ID NO: 375) includes the sequence starting from the amino terminus and ending immediately prior to the start of the linker. The full-length beta chain (SEQ ID NO: 376) includes the sequence starting immediately after the linker and ending with the carboxyl terminus.

Cancer reactive T cells were identified using the screening method set forth below. The method used to isolate the TCR is set forth below.

TCR name: 4213-PBL-TCR1
   Recognition of p53 mutation: R248Q
   Screening method: p53 "hotspot" mutation universal screening
   Co-culture to identify TCR: CD4+ Memory T cells after in vitro sensitization with R248Q long peptide were co-cultured with R248Q long peptide and CD4+41BB+ T cells were sorted
   Method to identify TCR: single-cell RT-PCR
   Abundance of TCR amongst all paired TCRs: 9.5% (observed 6 times of 63 pairs)
   TCR orientation: alpha-beta
   Expression vector: SB transposon (University of Minnesota, Minneapolis, MN)

(SEQ ID NO: 571)
MALLLVPAFQVIFTLGGTRAQSVTQLDSQVPVFEEAPVELRCNYS<u>SSVSV
YLFWYVQYPNQGLQLLLKYLSGSTLVES</u>INGFEAEFNKSQTSFHLRKPSV

-continued

HISDTAEYFCAVSKGTGAQKLVFGQGTRLTINPNIQNPEPAVYQLKDPRS

QDSTLCLFIDEDSQINVPKTMESGTFITDKCVLDMKAMDSKSNGAIAWSN

QTSFTCQDIFKETNATYPSSDVPCDAILTEKSFETDMNLNFQNLLVIVLR

ILLLKVAGFNLLMTLRLWSSRAKRSGSGATNFSLLKQAGDVEENPGPMHN

QVLCCVVLCFLGANTVDGGITQSPKYLFRKEGQNVTLSCEQNLNHDAMYW

YRQDPGQGLRLIYYSQIVNDFQKGDIAEGYSVSREKKESFPLIVTSAQKN

PTASYLCASEAFFGQGTRLTVVEDLRNVTPPKVSLFEPSKAEIANKQKAT

LVCLARGFFPDHVELSWWVNGKEVHSGVCTDPQAYKESNYSYCLSSRLRV

SATEWHNPRNHERCQVQFHGLSEEDKWPEGSPKPVTQNISAEAWGRADCG

ITSASYQQGVLSATILYEILLGKATLYAVLVSTLVVMAMVKRKNS

The statistics for TCR 4213-PBL-TCR1 of Patient 4213 are set forth in Table 26 below.

TABLE 26

| Parameter | # | Frequency |
|---|---|---|
| Total wells | 192 | 100% |
| CDR3alpha | 9 | 4.7% |
| CDR3beta | 6 | 3.1% |
| 4213-PBL-TCR1 pairs | 6 | 3.1% |
| Total paired TCRs | 63 | 32.8% |

The sequence of 4213-PBL-TCR2, which was isolated from Patient 4213, is set forth below. Starting from the amino terminus, the first underlined region is the CDR1alpha (SEQ ID NO: 377), the second underlined region is the CDR2alpha (SEQ ID NO: 378), the third underlined region is the CDR3alpha (SEQ ID NO: 379), the fourth underlined region is the CDR1beta (SEQ ID NO: 380), the fifth underlined region is the CDR2beta (SEQ ID NO: 381), and the sixth underlined region is the CDR3beta (SEQ ID NO: 382). The bold region is the linker (SEQ ID NO: 26). Starting from the amino terminus, the first italicized region is the alpha chain constant region (SEQ ID NO: 23) and the second italicized region is the beta chain constant region (SEQ ID NO: 25). The alpha chain variable region (SEQ ID NO: 383) includes the sequence starting from the amino terminus and ending immediately prior to the start of the alpha chain constant region. The beta chain variable region (SEQ ID NO: 384) includes the sequence starting immediately after the linker and ending immediately prior to the start of the beta chain constant region. The full-length alpha chain (SEQ ID NO: 385) includes the sequence starting from the amino terminus and ending immediately prior to the start of the linker. The full-length beta chain (SEQ ID NO: 386) includes the sequence starting immediately after the linker and ending with the carboxyl terminus.

Cancer reactive T cells were identified using the screening method set forth below. The method used to isolate the TCR is set forth below.
  TCR name: 4213-PBL-TCR2
  Recognition of p53 mutation: R248Q
  Screening method: p53 "hotspot" mutation universal screening
  Co-culture to identify TCR: CD4+ Memory T cells after in vitro sensitization with R248Q long peptide were co-cultured with R248Q long peptide and CD4+41BB+ T cells were sorted Method to identify TCR: single-cell RT-PCR
  Abundance of TCR amongst all paired TCRs: 7.9% (observed 5 times of 63 pairs)
  TCR orientation: alpha-beta
  Expression vector: SB transposon (SEQ ID NO: 572)
MALVTSITVLLSLGIMGDAKTTQPNSMESNEEEPVHLPCNHSTISGTDYI

HWYRQLPSQGPEYVIHGLTSNVNNRMASLAIAEDRKSSTLILHRATLRDA

AVYYCILASGAGSYQLTFGKGTKLSVIPNIQNPEPAVYQLKDPRSQDSTL

CLFTDFDSQINVPKTMESGTFITDKCVLDMKAMDSKSNGAIAWSNQTSFT

CQDIFKETNATYPSSDVPCDATLTEKSFETDMNLNFQNLLVIVLRILLLK

VAGFNLLMTLRLWSSRAKRSGSGATNFSLLKQAGDVEENPGPMHCRLLCC

VVFCLLQAGPLDTAVSQTPKYLVTQMGNDKSIKCEQNLGHDTMYWYKQDS

KKFLKIMFSYNNKELIINETVPNRFSPKSPDKAHLNLHINSLELGDSAVY

FCASRTIGYNTEAFFGQGTRLTVVEDLRNVTPPKVSLFEPSKAEIANKQK

ATLVCLARGFFPDIIVELSWWVNGKEVHSGVCTDPQAYKESNYSYCLSSR

LRVSATEWHNPRNHERCQVQFHGLSEEDKWPEGSPKPVTQNISAEAWGRA

DCGITSASYQQGVLSATILYEILLGKATLYAVLVSTLVVMAMVKRKNS

The statistics for TCR 4213-PBL-TCR2 of Patient 4213 are set forth in Table 27 below.

TABLE 27

| Parameter | # | Frequency |
|---|---|---|
| Total wells | 192 | 100% |
| CDR3alpha | 8 | 4.2% |
| CDR3beta | 8 | 4.2% |
| 4213-PBL-TCR2 pairs | 5 | 2.6% |
| Total paired TCRs | 63 | 32.8% |

The sequence of 4213-PBL-TCR3, which was isolated from Patient 4213, is set forth below. Starting from the amino terminus, the first underlined region is the CDR1alpha (SEQ ID NO: 387), the second underlined region is the CDR2alpha (SEQ ID NO: 388), the third underlined region is the CDR3alpha (SEQ ID NO: 389), the fourth underlined region is the CDR1beta (SEQ ID NO: 390), the fifth underlined region is the CDR2beta (SEQ ID NO: 391), and the sixth underlined region is the CDR3beta (SEQ ID NO: 392). The bold region is the linker (SEQ ID NO: 26). Starting from the amino terminus, the first italicized region is the alpha chain constant region (SEQ ID NO: 23) and the second italicized region is the beta chain constant region (SEQ ID NO: 25). The alpha chain variable region (SEQ ID NO: 393) includes the sequence starting from the amino terminus and ending immediately prior to the start of the alpha chain constant region. The beta chain variable region (SEQ ID NO: 394) includes the sequence starting immediately after the linker and ending immediately prior to the start of the beta chain constant region. The full-length alpha chain (SEQ ID NO: 395) includes the sequence starting from the amino terminus and ending immediately prior to the start of the linker. The full-length beta chain (SEQ ID NO: 396) includes the sequence starting immediately after the linker and ending with the carboxyl terminus.

Cancer reactive T cells were identified using the screening method set forth below. The method used to isolate the TCR is set forth below.

TCR name: 4213-PBL-TCR3
Recognition of p53 mutation: R248Q
Screening method: p53 "hotspot" mutation universal screening
Co-culture to identify TCR: CD4+ Memory T cells after in vitro sensitization with R248Q long peptide were co-cultured with R248Q long peptide and CD4+41BB+ T cells were sorted
Method to identify TCR: single-cell RT-PCR
Abundance of TCR amongst all paired TCRs: 6.3% (observed 4 times of 63 pairs)
TCR orientation: alpha-beta
Expression vector: SB transposon (SEQ ID NO: 573)
MAKIRQFLLAILWLQLSCVSAAKNEVEQSPQNLTAQEGEFITINCSYSVGI

SALHWLQQHPGGGIVSLFMLSSGKKKHGRLIATINIQEKHSSLHITASHPR

DSAVYICAALSYNTDKLIFGTGTRLQVFPNIQNPEPAVYQLKDPRSQDSTL

CLFTDFDSQINVPKTMESGTFITDKCVLDMKAMDSKSNGAMWSNQTSTICQ

DIFKETNATYPSSDVPCDATLTEKSFETDMNLNFQNLLVIVLRILLLKVAG

FNLLMTLRLWSSRAKRSGSGATNFSLLKQAGDVEENPGPMHTRLLCWAALC

LLGADHTGAGVSQTPSNKVTEKGKYVELRCDPISGHTALYWYRQSLGQGPE

FLIYFQGTGAADDSGLPNDRFFAVRPEGSVSTLKIQRTERGDSAVYLCASS

LSGLLQETQYFGPGTRLLVLEDLRNVTPPKVSLFERSKAEIANKQKATLVC

LARGFFPDHVELSWWVNGKEVHSGVCTDPQAYKESNYSYCLSSRLRVSATF

WHNPRNHFRCQVQFHGLSEEDKWPEGSPKPVTQNISAEAWGRADCGITSAS

YQQGVLSATILYEILLGKATLYAVLVSTLVVMAMVKRKNS

The statistics for TCR 4213-PBL-TCR3 of Patient 4213 are set forth in Table 28 below.

TABLE 28

| Parameter | # | Frequency |
|---|---|---|
| Total wells | 192 | 100% |
| CDR3alpha | 4 | 2.1% |
| CDR3beta | 7 | 3.6% |
| 4213-PBL-TCR3 pairs | 4 | 2.1% |
| Total paired TCRs | 63 | 32.8% |

The sequence of 4213-PBL-TCR4a1, which was isolated from Patient 4213, is set forth below. Starting from the amino terminus, the first underlined region is the CDR1alpha (SEQ ID NO: 397), the second underlined region is the CDR2alpha (SEQ ID NO: 398), the third underlined region is the CDR3alpha (SEQ ID NO: 399), the fourth underlined region is the CDR1beta (SEQ ID NO: 400), the fifth underlined region is the CDR2beta (SEQ ID NO: 401), and the sixth underlined region is the CDR3beta (SEQ ID NO: 402). The bold region is the linker (SEQ ID NO: 26). Starting from the amino terminus, the first italicized region is the alpha chain constant region (SEQ ID NO: 23) and the second italicized region is the beta chain constant region (SEQ ID NO: 25). The alpha chain variable region (SEQ ID NO: 403) includes the sequence starting from the amino terminus and ending immediately prior to the start of the alpha chain constant region. The beta chain variable region (SEQ ID NO: 404) includes the sequence starting immediately after the linker and ending immediately prior to the start of the beta chain constant region. The full-length alpha chain (SEQ ID NO: 405) includes the sequence starting from the amino terminus and ending immediately prior to the start of the linker. The full-length beta chain (SEQ ID NO: 406) includes the sequence starting immediately after the linker and ending with the carboxyl terminus.

Cancer reactive T cells were identified using the screening method set forth below. The method used to isolate the TCR is set forth below.

TCR name: 4213-PBL-TCR4a1
Recognition of p53 mutation: R248Q
Screening method: p53 "hotspot" mutation universal screening
Co-culture to identify TCR: CD4+ Memory T cells after in vitro sensitization with R248Q long peptide were co-cultured with R248Q long peptide and CD4+41BB+ T cells were sorted
Method to identify TCR: single-cell RT-PCR
Abundance of TCR amongst all paired TCRs: 3.2% (observed 2 times of 63 pairs)
TCR orientation: alpha-beta
Expression vector: SB transposon (SEQ ID NO: 574)
MAYSPGLVSLILLLLGRTRGNSVTQMEGPVTLSEEAFLTINCTYTATGYP

SLFWYVQYPGEGLQLLLKATKADDKGSNKGFEATYRKETTSFHLEKGSVQ

VSDSAVYFCALSHTGSSNTGKLIFGQGTRLQVKPNIQNPEPAVYQLKDPR

SQDSTLCLFIDFDSQINVPKTMESGTFITDKCVLDMKAMDSKSNGAIAWS

NQTSFTCQDIEKETNATYPSSDVPCDATLTEKSFETDMNLNFQNLLVIVL

RILLLKVAGFNLLMTLRLWSSRAKRSGSGATNFSLLKQAGDVEENPGPMH

TRLLCWAALCLLGAELTEAGVAQSPRYKIIEKRQSVAFWCNPISGHATLY

WYQQILGQGPKLLIQFQNNGVVDDSQLPKDRFSAERLKGVDSTLKIQPAK

LEDSAVYLCASSTGGGRHQPQHFGDGTRLSILEDLRNVTPPKVSLFEPSK

AEIANKQKATLVCLARGFFPDHVELSWWVNGKEVHSGVCTDPQAYKESNY

SYCLSSRLRVSATFWHNPRNTIFRCQVQFHGLSELDKWPEGSPKPVTQNI

SALAWGRADCGITSASYQQGVLSATILYEILLGKATLYAVLVSTLVVMAM

VKRKNS

The statistics for TCR 4213-PBL-TCR4a1 of Patient 4213 are set forth in Table 29 below.

TABLE 29

| Parameter | # | Frequency |
|---|---|---|
| Total wells | 192 | 100% |
| CDR3alpha | 2 | 1.0% |
| CDR3beta | 36 | 18.8% |
| 4213-PBL-TCR4a1 pairs | 2 | 1.0% |
| Total paired TCRs | 63 | 32.8% |

The sequence of 4213-PBL-TCR4a2, which was isolated from Patient 4213, is set forth below. Starting from the amino terminus, the first underlined region is the CDR1alpha (SEQ ID NO: 407), the second underlined region is the CDR2alpha (SEQ ID NO: 408), the third underlined region is the CDR3alpha (SEQ ID NO: 409), the fourth underlined region is the CDR1beta (SEQ ID NO: 410), the fifth underlined region is the CDR2beta (SEQ ID NO: 411), and the sixth underlined region is the CDR3beta (SEQ ID NO: 412). The bold region is the linker (SEQ ID NO: 26). Starting from the amino terminus, the first italicized region is the alpha chain constant region (SEQ ID NO: 23) and the second italicized region is the beta chain constant region (SEQ ID NO: 25). The alpha chain variable region (SEQ ID NO: 413) includes the sequence starting from the amino terminus and ending immediately prior to the start of the alpha chain constant region. The beta chain variable region (SEQ ID NO: 414) includes the sequence starting immediately after the linker and ending immediately prior to the start of the beta chain constant region. The full-length alpha chain (SEQ ID NO: 415) includes the sequence starting from the amino terminus and ending immediately prior to the start of the linker. The full-length beta chain (SEQ ID NO: 416) includes the sequence starting immediately after the linker and ending with the carboxyl terminus.

Cancer reactive T cells were identified using the screening method set forth below. The method used to isolate the TCR is set forth below.

TCR name: 4213-PBL-TCR4a2
Recognition of p53 mutation: R248Q
Screening method: p53 "hotspot" mutation universal screening
Co-culture to identify TCR: CD4+ Memory T cells after in vitro sensitization with R248Q long peptide were co-cultured with R248Q long peptide and CD4+41BB+ T cells were sorted
Method to identify TCR: single-cell RT-PCR
Abundance of TCR amongst all paired TCRs: 3.2% (observed 2 times of 63 pairs)
TCR orientation: alpha-beta
Expression vector: SB transposon (SEQ ID NO: 575)
MAYSPGLVSLILLLLGRTRGNSVTQMEGPVTLSEEAFLTINCTYTATGYP

SLFWYVQYPGEGLQLLLKATKADDKGSNKGFEATYRKETTSFHLEKGSVQ

VSDSAVYFCALSQTGSSKTGKLIFGQGTRLQVKPNIQNPEPAVYQLKDPR

SQDSTLCLFTDFDSQINVPKTMESGTFITDKCVLDMKAMDSKSNGAIAWS

NQTSFTCQDIFKETNATYPSSDVPCDATLTEKSFETDMNLNFQNLLVIVL

RILLLKVAGENLLMTLRLWSSRAKRSGSGATNFSLLKQAGDVEENPGPMH

TRLLCWAALCLLGAELTEAGVAQSPRYKIIEKRQSVAFWCNPISGHATLY

WYQQILGQGPKLLIQFQNNGVVDDSQLPKDRFSAERLKGVDSTLKIQPAK

LEDSAVYLCASSTGGGRHQPQHFGDGTRLSILEDLRNVTPPKVSLFEPSK

AEIANKQKATLVCLARGFFPDHVELSWWVNGKEVHSGVCTDPQAYKESIV

YSYCLSSRLRVSATEWHNPRNHERCQVQFHGLSEEDKWPEGSPKPVTQNI

SAEAWGRADCGITSASYQQGVLSATILYEILLGKATLYAVLVSTLVVMAM

VKRKNS

The statistics for TCR 4213-PBL-TCR4a2 of Patient 4213 are set forth in Table 30 below.

TABLE 30

| Parameter | # | Frequency |
|---|---|---|
| Total wells | 192 | 100% |
| CDR3alpha | 2 | 1.0% |
| CDR3beta | 36 | 18.8% |

TABLE 30-continued

| Parameter | # | Frequency |
|---|---|---|
| 4213-PBL-TCR4a2 pairs | 2 | 1.0% |
| Total paired TCRs | 63 | 32.8% |

The sequence of 4213-PBL-TCR4a3, which was isolated from Patient 4213, is set forth below. Starting from the amino terminus, the first underlined region is the CDR1alpha (SEQ ID NO: 417), the second underlined region is the CDR2alpha (SEQ ID NO: 418), the third underlined region is the CDR3alpha (SEQ ID NO: 419), the fourth underlined region is the CDR1beta (SEQ ID NO: 420), the fifth underlined region is the CDR2beta (SEQ ID NO: 421), and the sixth underlined region is the CDR3beta (SEQ ID NO: 422). The bold region is the linker (SEQ ID NO: 26). Starting from the amino terminus, the first italicized region is the alpha chain constant region (SEQ ID NO: 23) and the second italicized region is the beta chain constant region (SEQ ID NO: 25). The alpha chain variable region (SEQ ID NO: 423) includes the sequence starting from the amino terminus and ending immediately prior to the start of the alpha chain constant region. The beta chain variable region (SEQ ID NO: 424) includes the sequence starting immediately after the linker and ending immediately prior to the start of the beta chain constant region. The full-length alpha chain (SEQ ID NO: 425) includes the sequence starting from the amino terminus and ending immediately prior to the start of the linker. The full-length beta chain (SEQ ID NO: 426) includes the sequence starting immediately after the linker and ending with the carboxyl terminus.

Cancer reactive T cells were identified using the screening method set forth below. The method used to isolate the TCR is set forth below.

TCR name: 4213-PBL-TCR4a3
Recognition of p53 mutation: R248Q
Screening method: p53 "hotspot" mutation universal screening
Co-culture to identify TCR: CD4+ Memory T cells after in vitro sensitization with R248Q long peptide were co-cultured with R248Q long peptide and CD4+41BB+ T cells were sorted
Method to identify TCR: single-cell RT-PCR
Abundance of TCR amongst all paired TCRs: 4.8% (observed 3 times of 63 pairs)
TCR orientation: alpha-beta
Expression vector: SB transposon (SEQ ID NO: 576)
MAYSPGLVSLILLLLGRTRGNSVTQMEGPVTLSEEAFLTINCTYTATGYP

SLFWYVQYPGEGLQLLLKATKADDKGSNKGFEATYRKETTSFHLEKGSVQ

VSDSAVYFCALSQTGSSNTGKLIFGQGTRLQVKPNIQNPEPAVYQLKDPR

SQDSTLCLFTDFDSQINVPKTMESGTFITDKCVLDMKAMDSKSNGAIAWS

NQTSFTCQDIFKETNATYPSSDVPCDATLTEKSFETDMNLNFQNLLVIVL

RILLLKVAGFNLLMTLRLWSSRAKRSGSGATNFSLLKQAGDVEENPGPMH

TRLLCWAALCLLGAELTEAGVAQSPRYKIIEKRQSVAFWCNPISGHATLY

WYQQILGQGPKLLIQFQNNGVVDDSQLPKDRFSAERLKGVDSTLKIQPAK

LEDSAVYLCASSTGGGRHQPQHFGDGTRLSILEDLRNVIPPKVSLFEPSK

AEIANKQKATLVCLARGFFPDHVELSWWVNGKEVHSGVCTDPQAYKESNY

-continued

SYCLSSRLRVSATEWHNPRNHFRCQVQFHGLSEEDKWPEGSPKPVTQNIS

AEAWGRADCGITSASYQQGVLSATILYEILLGKATLYAVLVSTLVVMAMV

KRKNS

The statistics for TCR 4213-PBL-TCR4a3 of Patient 4213 are set forth in Table 31 below.

TABLE 31

| Parameter | # | Frequency |
|---|---|---|
| Total wells | 192 | 100% |
| CDR3alpha | 4 | 2.1% |
| CDR3beta | 36 | 18.8% |
| 4213-PBL-TCR4a3 pairs | 3 | 1.6% |
| Total paired TCRs | 63 | 32.8% |

The sequence of 4213-PBL-TCR4a4, which was isolated from Patient 4213, is set forth below. Starting from the amino terminus, the first underlined region is the CDR1alpha (SEQ ID NO: 427), the second underlined region is the CDR2alpha (SEQ ID NO: 428), the third underlined region is the CDR3alpha (SEQ ID NO: 429), the fourth underlined region is the CDR1beta (SEQ ID NO: 430), the fifth underlined region is the CDR2beta (SEQ ID NO: 431), and the sixth underlined region is the CDR3beta (SEQ ID NO: 432). The bold region is the linker (SEQ ID NO: 26). Starting from the amino terminus, the first italicized region is the alpha chain constant region (SEQ ID NO: 23) and the second italicized region is the beta chain constant region (SEQ ID NO: 25). The alpha chain variable region (SEQ ID NO: 433) includes the sequence starting from the amino terminus and ending immediately prior to the start of the alpha chain constant region. The beta chain variable region (SEQ ID NO: 434) includes the sequence starting immediately after the linker and ending immediately prior to the start of the beta chain constant region. The full-length alpha chain (SEQ ID NO: 435) includes the sequence starting from the amino terminus and ending immediately prior to the start of the linker. The full-length beta chain (SEQ ID NO: 436) includes the sequence starting immediately after the linker and ending with the carboxyl terminus.

Cancer reactive T cells were identified using the screening method set forth below. The method used to isolate the TCR is set forth below.

TCR name: 4213-PBL-TCR4a4
Recognition of p53 mutation: R248Q
Screening method: p53 "hotspot" mutation universal screening
Co-culture to identify TCR: CD4+ Memory T cells after in vitro sensitization with R248Q long peptide were co-cultured with R248Q long peptide and CD4+41BB+ T cells were sorted
Method to identify TCR: single-cell RT-PCR
Abundance of TCR amongst all paired TCRs: 3.2% (observed 2 times of 63 pairs)
TCR orientation: alpha-beta
Expression vector: SB transposon (SEQ ID NO: 577)
MAYSPGLVSLILLLLGRTRGNSVTQMEGPVTLSEEAFLTINCTYT<u>ATGYPS</u>

LFWYVQYPGEGLQLLL<u>KATKADD</u>KGSNKGFEATYRKETTSFHLEKGSVQVS

DSAVYF<u>CALSTTGSSNTGKLI</u>FGQGTTLQVKPNIQNPEPAVYQLKDPRSQD

STLCLFTDFDSQINVPKTMESGTFITDKCVLDMKAIVIDSKSNGAIAWSNQ

TSFTCQDIFKETNATYPSSDVPCDATLTEKSFETDMNLNFQNLLVIVLRIL

LLKVAGFNLLMTLRLWSSRAKRSGSGATNFSLLKQAGDVEENPGPMHTRLL

CWAALCLLGAELTEAGVAQSPRYKIIEKRQSVAFWCNPI<u>SGHATL</u>YWYQQI

LGQGPKLLIQ<u>FQNNG</u>VVDDSQLPKDRFSAERLKGVDSTLKIQPAKLEDSAV

YL<u>CASSTGGGRHQPQHF</u>GDGTRLSIL*EDLRNVTPPKVSLFEPSKAEIANKQ*

*KATLVCLARGFFPDHVELSWWVNGKEVIISGVCTDPQAYKESNYSYCLSSR*

*LRVSATFWHNPRNHFRCQVQFHGLSEEDKWPEGSPKPVTQNISAEAWGRAD*

*CGITSASYQQGVLSATILYEILLGKATLYAVLVSTLVVMAMVKRKNS*

The statistics for TCR 4213-PBL-TCR4a4 of Patient 4213 are set forth in Table 32 below.

TABLE 32

| Parameter | # | Frequency |
|---|---|---|
| Total wells | 192 | 100% |
| CDR3alpha | 2 | 1.0% |
| CDR3beta | 36 | 18.8% |
| 4213-PBL-TCR4a3 pairs | 2 | 1.0% |
| Total paired TCRs | 63 | 32.8% |

Example 8

This example demonstrates the identification of anti-mutated p53 T cells in Patient 4268 by co-culturing autologous APCs induced to express mutated p53 within autologous T cells ("p53 hotspot mutation universal screening"). This example also demonstrates the isolation of five anti-mutated p53 TCRs from patient 4268.

Experiments were carried out as described for FIGS. 27-30 for Patient 4268.

TIL fragments (F1-F24, n=24) from patient 4268 were co-cultured with autologous APCs electroporated with TMG composed of irrelevant, WT p53, or mutated p53 sequence. Co-cultures were performed overnight at 37° C. Secretion of IFN-γ was evaluated using ELISPOT assay. The results are shown in FIG. 27.

TIL fragments (F1-F24, n=24) from patient 4268 were co-cultured with autologous APCs pulsed with peptide vehicle (DMSO) or purified (>95% by HPLC) 25-amino acid peptides composed of WT p53-R248 sequence or mutated p53-R248Q sequence. Co-cultures were performed overnight at 37° C. Secretion of IFN-γ was evaluated using ELISPOT assay. The results are shown in FIG. 28.

TIL fragments (F1-F24, n=24) from patient 4268 were co-cultured with autologous APCs pulsed with peptide vehicle (DMSO) or purified (>95% by HPLC) 25-amino acid peptides composed of wt p53-R248 sequence or mutated p53-R248Q sequence. Co-cultures were performed overnight at 37° C. Expression of 4-1BB was evaluated by flow cytometry after gating for lymphocytes→living cells (PI negative)→CD3+ (T cells). The results are shown in FIG. 29. TIL fragments F18 and F19 were sources of TCRs after sorting CD4+41BB+ T cells.

TIL fragments (F1-F24, n=24) from patient 4268 were co-cultured with autologous APCs pulsed with peptide vehicle (DMSO) or purified (>95% by HPLC) 25-amino acid peptides composed of WT p53-R248 sequence or mutated p53-R248Q sequence. Co-cultures were performed overnight at 37° C. Expression of 4-1BB was evaluated by flow cytometry after gating for lymphocytes→living cells (PI negative)→CD3+ (T cells). The results are shown in FIG. 30. TIL fragments F7, F8, and F15 were sources of TCRs after sorting CD8+4-1BB+ T cells.

The sequence of 4268-TCR1, which was isolated from Patient 4268, is set forth below. Starting from the amino terminus, the first underlined region is the CDR1alpha (SEQ ID NO: 137), the second underlined region is the CDR2alpha (SEQ ID NO: 138), the third underlined region is the CDR3alpha (SEQ ID NO: 139), the fourth underlined region is the CDR1beta (SEQ ID NO: 140), the fifth underlined region is the CDR2beta (SEQ ID NO: 141), and the sixth underlined region is the CDR3beta (SEQ ID NO: 142). The bold region is the linker (SEQ ID NO: 26). Starting from the amino terminus, the first italicized region is the alpha chain constant region (SEQ ID NO: 23) and the second italicized region is the beta chain constant region (SEQ ID NO: 25). The alpha chain variable region (SEQ ID NO: 143) includes the sequence starting from the amino terminus and ending immediately prior to the start of the alpha chain constant region. The beta chain variable region (SEQ ID NO: 144) includes the sequence starting immediately after the linker and ending immediately prior to the start of the beta chain constant region. The full-length alpha chain (SEQ ID NO: 145) includes the sequence starting from the amino terminus and ending immediately prior to the start of the linker. The full-length beta chain (SEQ ID NO: 146) includes the sequence starting immediately after the linker and ending with the carboxyl terminus.

Cancer reactive T cells were identified using the screening method set forth below. The method used to isolate the TCR is set forth below.

TCR name: 4268-TCR1
Recognition of p53 mutation: R248Q
Method: p53 "hotspot" mutation universal screening
Co-culture to identify TCR: Co-culture 4268-F7 and 4268-F8 with p53-R248Q long peptide, sorted CD8+ 41BB+ T cells
Method to identify TCR: single-cell RT-PCR
Abundance of TCR amongst all paired TCRs: 78.7% (observed 48 times of 61 pairs)
TCR orientation: alpha-beta
Expression vector: SB transposon (SEQ ID NO: 578)
MASLRVLLVILWLQLSWVWSQQKEVEQNSGPLSVPEGAIASLNCTYSDRG

SQSFFWYRQYSGKSPELIMFIYSNGDKEDGRFTAQLNKASQYVSLLIRDS

QPSDSATYLCAVSWYSTLTFGKGTMLLVSP*NIQNPEPAVYQLKDPRSQDS*

*TLCLFTDFDSQINVPKTMESGTFITDKCVLDMKAMDSKSNGAMWSNQTSE*

*TCQDIFKETNATYPSSDVPCDATLTEKSFETDMNLNFQNLLVIVLRILLL*

*KVAGENLLMTLRLWSS*RAKRSGSGATNFSLLKQAGDVEENPGPMHTRLFF

YVALCLLWAGHRDAGITQSPRYKITETGRQVTLMCHQTWSHSYMFWYRQD

LGHGLRLIYYSAAADITDKGEVPDGYVVSRSKTENFPLTLESATRSQTSV

YFCASSGSRTDTQYFGPGTRLTVL*EDLRNVTPPKVSLFEPSKAEIANKQK*

*ATLVCLARGFFPDHVELSWWVNGKEVHSGVCTDPQAYKESNYSYCLSSRL*

-continued
*RVSATEWHNPRNHFRCQVQFHGLSEEDKWPEGSPKPVTQNISAEAWGRAD*

*CGITSASYQQGVLSATILYEILLGKATLYAVLVSTLVVMAMVKRKNS*

The statistics for TCR 4268-TCR1 of Patient 4268 are set forth in Table 33 below.

TABLE 33

| Parameter | # | Frequency |
|---|---|---|
| Total wells | 96 | 100% |
| CDR3alpha | 54 | 56.3% |
| CDR3beta | 71 | 74.0% |
| 4268-TCR1 pairs | 48 | 50.0% |
| Total paired TCRs | 61 | 63.5% |

The sequence of 4268-TCR2, which was isolated from Patient 4268, is set forth below. Starting from the amino terminus, the first underlined region is the CDR1alpha (SEQ ID NO: 147), the second underlined region is the CDR2alpha (SEQ ID NO: 148), the third underlined region is the CDR3alpha (SEQ ID NO: 149), the fourth underlined region is the CDR1beta (SEQ ID NO: 150), the fifth underlined region is the CDR2beta (SEQ ID NO: 151), and the sixth underlined region is the CDR3beta (SEQ ID NO: 152). The bold region is the linker (SEQ ID NO: 26). Starting from the amino terminus, the first italicized region is the alpha chain constant region (SEQ ID NO: 23) and the second italicized region is the beta chain constant region (SEQ ID NO: 25). The alpha chain variable region (SEQ ID NO: 153) includes the sequence starting from the amino terminus and ending immediately prior to the start of the alpha chain constant region. The beta chain variable region (SEQ ID NO: 154) includes the sequence starting immediately after the linker and ending immediately prior to the start of the beta chain constant region. The full-length alpha chain (SEQ ID NO: 155) includes the sequence starting from the amino terminus and ending immediately prior to the start of the linker. The full-length beta chain (SEQ ID NO: 156) includes the sequence starting immediately after the linker and ending with the carboxyl terminus.

Cancer reactive T cells were identified using the screening method set forth below. The method used to isolate the TCR is set forth below.

TCR name: 4268-TCR2
Recognition of p53 mutation: R248Q
Method: p53 "hotspot" mutation universal screening
Co-culture to identify TCR: Co-culture 4268-F7 and 4268-F8 with p53-R248Q long peptide, sorted CD8+ 41BB+ T cells
Method to identify TCR: single-cell RT-PCR
Abundance of TCR amongst all paired TCRs: 6.6% (observed 4 times of 61 pairs)
TCR orientation: alpha-beta
Expression vector: SB transposon (SEQ ID NO: 579)
MALKFSVSILWIQLAWVSTQLLEQSPQFLSIQEGENLTVYCNSSSVFSSL

QWYRQEPGEGPVLLVTVVTGGEVKKLKRLTFQFGDARKDSSLHITAAQPG

DTGLYLCAGEFAGNQFYFGTGTSLTVIP*NIQNPEPAVYQLKDPRSQDSTL*

*CIFTDFDSQINVPKTMESGTFITDKCVLDMKAMDSKSNGAIAWSNQTSFT*

*CQDIFKETNATYPSSDVPCDATLTEKSFETDMNLNFQNLLVIVLRILLLK*

*VAGFNLLMTLRLWSS*RAKRSGSGATNFSLLKQAGDVEENPGPMHCRLLCC

-continued

AVLCLLGAVPIDTEVTQTPKHLVMGMTNKKSLKCEQHMGHRAMYWYKQKA

KKPPELMFVYSYEKLSINESVPSRFSPECPNSSLLNLHLHALQPEDSALY

LCASSQVGLTYEQYFGPGTRLTVT*EDLRNVTPPKVSLFEPSKAEIANKQI*

*CATLVCLARGFFPDHVELSWWVNGKEVHSGVCTDPQAYKESNYSYCLSSR*

*LRVSATFWHNPRNHFRCQVQFHGLSEEDKWPEGSPKPVTQNISAEAWGRA*

*DCGITSASYQQGVLSATILYEILLGKATLYAVLVSTLVVMAMVKRKNS*

The statistics for TCR 4268-TCR2 of Patient 4268 are set forth in Table 34 below.

TABLE 34

| Parameter | # | Frequency |
|---|---|---|
| Total wells | 96 | 100% |
| CDR3alpha | 6 | 6.3% |
| CDR3beta | 4 | 4.2% |
| 4268-TCR2 pairs | 4 | 4.2% |
| Total paired TCRs | 61 | 63.5% |

The sequence of 4268-TCR3, which was isolated from Patient 4268, is set forth below. Starting from the amino terminus, the first underlined region is the CDR1alpha (SEQ ID NO: 157), the second underlined region is the CDR2alpha (SEQ ID NO: 158), the third underlined region is the CDR3alpha (SEQ ID NO: 159), the fourth underlined region is the CDR1beta (SEQ ID NO: 160), the fifth underlined region is the CDR2beta (SEQ ID NO: 161), and the sixth underlined region is the CDR3beta (SEQ ID NO: 162). The bold region is the linker (SEQ ID NO: 26). Starting from the amino terminus, the first italicized region is the alpha chain constant region (SEQ ID NO: 23) and the second italicized region is the beta chain constant region (SEQ ID NO: 25). The alpha chain variable region (SEQ ID NO: 163) includes the sequence starting from the amino terminus and ending immediately prior to the start of the alpha chain constant region. The beta chain variable region (SEQ ID NO: 164) includes the sequence starting immediately after the linker and ending immediately prior to the start of the beta chain constant region. The full-length alpha chain (SEQ ID NO: 165) includes the sequence starting from the amino terminus and ending immediately prior to the start of the linker. The full-length beta chain (SEQ ID NO: 166) includes the sequence starting immediately after the linker and ending with the carboxyl terminus.

Cancer reactive T cells were identified using the screening method set forth below. The method used to isolate the TCR is set forth below.

TCR name: 4268-TCR3

Recognition of p53 mutation: R248Q

Method: p53 "hotspot" mutation universal screening

Co-culture to identify TCR: Co-culture 4268-F15 with p53-R248Q long peptide, sorted CD8+41BB+ T cells Method to identify TCR: single-cell RT-PCR Abundance of TCR amongst all paired TCRs: 88.6% (observed 31 times of 35 pairs)

TCR orientation: alpha-beta

Expression vector: SB transposon (SEQ ID NO: 580)
MASAPISMLAMLFTLSGLRAQSVAQPEDQVNVAEGNPLTVKCTYSVSGNP

YLFWYVQYPNRGLQFLLKYITGDNLVKGSYGFEAEFNKSQTSFHLKKPSA

LVSDSALYFCAVRDNSGGSNYKLTFGKGTLLTVNP*NIQNPEPAVYQLKDP*

*RSQDSTLCLFTDFDSQINVPKTMESGTFITDKCVLDMKAMDSKSNGAIAW*

*SNQTSFTCQDIFKETNATYPSSDVPCDATLTEKSFETDMNLNFQNLLVIV*

*LRILLLKVAGFNLLMTLRLWSS*RAKRSGSGATNFSLLKQAGDVEENPGPM

HTRLLCWAALCLLGAELTEAGVAQSPRYKIIEKRQSVAFWCNPISGHATL

YWYQQILGQGPKLLIQFQNNGVVDDSQLPKDRFSAERLKGVDSTLKIQPA

KLEDSAVYLCASSLGOGQTQYFGPGTRLLVL*EDLRNVTPPKVSLFEPSKA*

*EIANKQKATLVCLARGFFPDHVELSWWVNGKEVHSGVCTDPQAYKESNYS*

*YCLSSRLRVSATFWIINPRNHFRCQVQFTIGLSEEDKWPEGSPKPVTQNI*

*SAEAWGRADCGITSASYQQGVISATILYEILLGKATLYAVLVSTLVVMAM*

*VKRKNS*

The statistics for TCR 4268-TCR3 of Patient 4268 are set forth in Table 35 below.

TABLE 35

| Parameter | # | Frequency |
|---|---|---|
| Total wells | 96 | 100% |
| CDR3alpha | 42 | 43.8% |
| CDR3beta | 37 | 38.5% |
| 4268-TCR3 pairs | 31 | 32.3% |
| Total paired TCRs | 35 | 36.5% |

The sequence of 4268-TCR4, which was isolated from Patient 4268, is set forth below. Starting from the amino terminus, the first underlined region is the CDR1alpha (SEQ ID NO: 167), the second underlined region is the CDR2alpha (SEQ ID NO: 168), the third underlined region is the CDR3alpha (SEQ ID NO: 169), the fourth underlined region is the CDR1beta (SEQ ID NO: 170), the fifth underlined region is the CDR2beta (SEQ ID NO: 171), and the sixth underlined region is the CDR3beta (SEQ ID NO: 172). The bold region is the linker (SEQ ID NO: 26). Starting from the amino terminus, the first italicized region is the alpha chain constant region (SEQ ID NO: 23) and the second italicized region is the beta chain constant region (SEQ ID NO: 25). The alpha chain variable region (SEQ ID NO: 173) includes the sequence starting from the amino terminus and ending immediately prior to the start of the alpha chain constant region. The beta chain variable region (SEQ ID NO: 174) includes the sequence starting immediately after the linker and ending immediately prior to the start of the beta chain constant region. The full-length alpha chain (SEQ ID NO: 175) includes the sequence starting from the amino terminus and ending immediately prior to the start of the linker. The full-length beta chain (SEQ ID NO: 176) includes the sequence starting immediately after the linker and ending with the carboxyl terminus.

Cancer reactive T cells were identified using the screening method set forth below. The method used to isolate the TCR is set forth below.

TCR name: 4268-TCR4

Recognition of p53 mutation: R248Q

Method: p53 "hotspot" mutation universal screening

Co-culture to identify TCR: Co-culture 4268-F18 with p53-R248Q long peptide, sorted CD4+41BB+ T cells Method to identify TCR: single-cell RT-PCR
Abundance of TCR amongst all paired TCRs: 95.2% (observed 40 times of 42 pairs)
TCR orientation: alpha-beta
Expression vector: SB transposon (SEQ ID NO: 581)
MALLLVPAFQVIFTLGGTRAQSVTQLDSQVPVFEEAPVELRCNYSSSVSV

YLFWYVQYPNQGLQLLLKYLSGSTLVESINGFEAEFNKSQTSFHLRKPSV

HISDTAEYFCAVRGSSGTYKYIFGTGTRLKVLAN*IQNPEPAVYQLKDPRS*

*QDSTLCLFTDFDSQINVPKTMESGTFITDKCVLDMKAMDSKSNGAIAWSN*

*QTSFTCQDIFKETNATYPSSDVPCDATLTEKSFETDMNLNFQNLLVIVLR*

*ILLLKVAGFNLLMTLRLWS*RAKRSGSGATNFSLLKQAGDVEENPGPMHI

RLLCRVAFCFLAVGLVDVKVTQSSRYLVKRTGEKVFLECVQDMDHENMFW

YRQDPGLGLRLIYFSYDVKMKEKGDIPEGYSVSREKKERFSLILESASTN

QTSMYLCASKGDONTEAFFGQGTRLTVVEDLRNVTPPKVSLFEPSKANAN

KQKATLVCLARGFFPDHVELSWWVNGKEVHSGVCTDPQAYKESNYSYCLS

SRLRVSATFWHNPRNHERCQVQFHGLSEEDKWPEGSPKPVTQNISAEAWG

RADCGITSASYQQGVLSATILYEILLGKATLYAVLVSTLVVMAMVKRKNS

The statistics for TCR 4268-TCR4 of Patient 4268 are set forth in Table 36 below.

TABLE 36

| Parameter | # | Frequency |
|---|---|---|
| Total wells | 96 | 100% |
| CDR3alpha | 43 | 44.8% |
| CDR3beta | 53 | 55.2% |
| 4268-TCR4 pairs | 40 | 41.7% |
| Total paired TCRs | 42 | 43.8% |

The sequence of 4268-TCR5, which was isolated from Patient 4268, is set forth below. Starting from the amino terminus, the first underlined region is the CDR1alpha (SEQ ID NO: 177), the second underlined region is the CDR2alpha (SEQ ID NO: 178), the third underlined region is the CDR3alpha (SEQ ID NO: 179), the fourth underlined region is the CDR1beta (SEQ ID NO: 180), the fifth underlined region is the CDR2beta (SEQ ID NO: 181), and the sixth underlined region is the CDR3beta (SEQ ID NO: 182). The bold region is the linker (SEQ ID NO: 26). Starting from the amino terminus, the first italicized region is the alpha chain constant region (SEQ ID NO: 23) and the second italicized region is the beta chain constant region (SEQ ID NO: 25). The alpha chain variable region (SEQ ID NO: 183) includes the sequence starting from the amino terminus and ending immediately prior to the start of the alpha chain constant region. The beta chain variable region (SEQ ID NO: 184) includes the sequence starting immediately after the linker and ending immediately prior to the start of the beta chain constant region. The full-length alpha chain (SEQ ID NO: 185) includes the sequence starting from the amino terminus and ending immediately prior to the start of the linker. The full-length beta chain (SEQ ID NO: 186) includes the sequence starting immediately after the linker and ending with the carboxyl terminus.

Cancer reactive T cells were identified using the screening method set forth below. The method used to isolate the TCR is set forth below.

TCR name: 4268-TCR5
Recognition of p53 mutation: R248Q
Method: p53 "hotspot" mutation universal screening
Co-culture to identify TCR: Co-culture 4268-F19 with p53-mut-TMG, sorted CD4+41BB+ T cells
Method to identify TCR: single-cell RT-PCR
Abundance of TCR amongst all paired TCRs: 11.8% (observed 2 times of 17 pairs)
TCR orientation: alpha-beta
Expression vector: SB transposon (SEQ ID NO: 582)
MAGVFLLYVSMKMGGTTGQNIDQPTEMTATEGAIVQINCTYQTSGFNGLF

WYQQHAGEAPTFLSYNVLDGLEEKGRFSSFLSRSKGYSYLLLKELQMKDS

ASYLCAVRDLQTGANNLFFGTGTRLTVI*PNIQNPEPAVYQLKDPRSQDST*

*LCLETDFDSQINVPKTMESGTEITDKCVLDMKAMDSKSNGAIAWSNQTSF*

*TCQDIFKETNATYPSSDVPCDATLTEKSFETDMNLNFQNLLVIVLRILLL*

*KVAGENLLMTLRLWS*RAKRSGSGATNFSLLKQAGDVEENPGPMHIRLLC

RVAFCFLAVGLVDVKVTQSSRYLVKRTGEKVFLECVQDMDHENMFWYRQD

PGLGLRLIYFSYDVKMKEKGDIPEGYSVSREKKERFSLILESASTNQTSM

YLCASSLTFGTTEAFFGQGTRLTVV*EDLRNVTPPKVSLFEPSKAEIANKQ*

*KATLVCLARGFFPDHVELSWWVNGKEVHSGVCTDPQAYKESNYSYCLSSR*

*LRVSATEWHNPRNHERCQVQFHGLSEEDKWPEGSPKPVTQNISAEAWGRA*

*DCGITSASYQQGVLSATILYEILLGKATLYAVLVSTLVVMAMVKRKNS*

The statistics for TCR 4268-TCR5 of Patient 4268 are set forth in Table 37 below.

TABLE 37

| Parameter | # | Frequency |
|---|---|---|
| Total wells | 96 | 100% |
| CDR3alpha | 2 | 2.1% |
| CDR3beta | 87 | 90.6% |
| 4268-TCR5 pairs | 2 | 2.1% |
| Total paired TCRs | 17 | 17.7% |

Example 9

This example demonstrates the identification of anti-mutated p53 T cells in Patient 4266 by co-culturing autologous APCs induced to express mutated p53 within autologous T cells ("p53 hotspot mutation universal screening"). This example also demonstrates the isolation of four anti-mutated p53 TCRs from patient 4266.

Experiments were carried out as described for FIGS. 31-34 and 53-55 for Patient 4266.

TIL fragments (F1-F24, n=24) from patient 4266 were co-cultured with autologous APCs electroporated with TMG composed of irrelevant, WT p53, or mutated p53 sequence. Co-cultures were performed overnight at 37° C. Secretion of IFN-γ was evaluated using ELISPOT assay. The results are shown in FIG. 31. Expression of 4-1BB was evaluated by flow cytometry after gating for lymphocytes→living cells (PI negative)→CD3+ (T cells). The results are shown in FIG. 32.

TIL fragments (F1-F24, n=24) from patient 4266 were co-cultured with autologous APCs pulsed with peptide vehicle (DMSO) or purified (>95% by HPLC) 25-amino acid peptides composed of WT p53-R248 sequence or mutated p53-R248W sequence. Co-cultures were performed overnight at 37° C. Secretion of IFN-γ was evaluated using ELISPOT assay. The results are shown in FIG. 33. Expression of 4-1BB was evaluated by flow cytometry after gating for lymphocytes→living cells (PI negative)→CD3+ (T cells). The results are shown in FIG. 34.

Cos 7 cells (2.5×10$^4$ per well) were plated on wells of flat-bottom 96 well plates. The following day, cells were co-transfected with individual HLA alleles from patient 4266. The next day cells were pulsed with no peptide, DMSO, wild type p53-R248 peptide SSCMGGMNRR (SEQ ID NO: 590) or mutated p53-R248W peptide SSCMGGMNWR (SEQ ID NO: 591) for 2 hours at 37° C. at 1 μg/mL. TIL cultures from patient 4266 (10$^5$) were added to wells and co-cultured overnight at 37° C. Expression of 4-1 BB was evaluated by flow cytometry after gating for lymphocytes→living cells (PI negative)→CD3+ (T cells)→CD4−CD8+. The results are shown in FIG. 53.

T cells expressing mock (no TCR), 4266-TCR1, 4266-TCR2, 4266-TCR3 or 4266-TCR4 with putative specificity to p53-R248W identified from 4266-TIL were co-cultured with autologous APCs which were pulsed with peptide vehicle (DMSO) or purified (>95% by HPLC) 25 amino acid peptides composed of WT p53-R248 sequence or mutated p53-R248W sequences. Media alone and PMA and Ionomycin were negative and positive controls, respectively. Co-cultures were performed overnight at 37° C. Expression of 4-1BB was evaluated by flow cytometry after gating for lymphocytes→living cells (PI negative)→CD3+(T cells)→CD4−CD8+. The results are shown in FIG. 54.

A tumor cell (TC) line was established from a xenografted tumor fragment resected from Patient 4266 then serially passaged through immunocompromised mice (TC #4266). The TC #4266 was co-cultured with T cells (10$^5$) expressing mock (no TCR) or p53-R248W-specific TCRs (4266-TCR2, 4266-TCR3 or 4266-TCR4) overnight at 37° C. The TC #4266 cells were either incubated with nothing, W6/32 pan-HLA Class-1 specific blocking antibody, IVA12 pan-HLA Class-II specific blocking antibody or mutated p53-R248W peptide SSCMGGMNWR (SEQ ID NO: 591) for 2 hours at 37° C. The antibodies were kept in the co-culture at 5 μg/mL final concentration. The peptide was incubated at 1 g/mL and excess peptide was washed after incubation. Media alone (no TC) and PMA and Ionomycin were negative and positive controls, respectively. Expression of 4-1 BB was evaluated by flow cytometry after gating for lymphocytes→living cells (PI negative)→CD3+ (T cells)→CD4−CD8+. The results are shown in FIG. 55.

The sequence of 4266-TCR1, which was isolated from Patient 4266, is set forth below. Starting from the amino terminus, the first underlined region is the CDR1alpha (SEQ ID NO: 97), the second underlined region is the CDR2alpha (SEQ ID NO: 98), the third underlined region is the CDR3alpha (SEQ ID NO: 99), the fourth underlined region is the CDR1beta (SEQ ID NO: 100), the fifth underlined region is the CDR2beta (SEQ ID NO: 101), and the sixth underlined region is the CDR3beta (SEQ ID NO: 102). The bold region is the linker (SEQ ID NO: 26). Starting from the amino terminus, the first italicized region is the alpha chain constant region (SEQ ID NO: 23) and the second italicized region is the beta chain constant region (SEQ ID NO: 25). The alpha chain variable region (SEQ ID NO: 103) includes the sequence starting from the amino terminus and ending immediately prior to the start of the alpha chain constant region. The beta chain variable region (SEQ ID NO: 104) includes the sequence starting immediately after the linker and ending immediately prior to the start of the beta chain constant region. The full-length alpha chain (SEQ ID NO: 105) includes the sequence starting from the amino terminus and ending immediately prior to the start of the linker. The full-length beta chain (SEQ ID NO: 106) includes the sequence starting immediately after the linker and ending with the carboxyl terminus.

Cancer reactive T cells were identified using the screening method set forth below. The method used to isolate the TCR is set forth below.

TCR name: 4266-TCR1
Recognition of p53 mutation: R248W
Screening method: p53 "hotspot" mutation universal screening
Co-culture to identify TCR: Co-culture 4266-F1, 4266-F3, 4266-F5 and 4266-F6 with p53mutTMG or R248W long peptide (both co-cultures detected the same TCR), sorted CD8+41BB+ T cells
Method to identify TCR: single-cell RT-PCR
Abundance of TCR amongst all paired TCRs: 17.0% (observed 9 times of 53 pairs)
TCR orientation: alpha-beta
Expression vector: SB transposon (SEQ ID NO: 583)
MALLLVPAFQVIFTLGGTRAQSVTQLDSQVPVFEEAPVELRCNYSSSVSV

YLFWYVQYPNQGLQLLLKYLSGSTLVESINGFEAEFNKSQTSFHLRKPSV

HISDTAEYFCAVSDLVRDDKIIFGKGTRLHILPNIQNPEPAVYQLKDPRS

QDSTLCLFTDFDSQINVPKTMESGTFITDKCVLDMKAMDSKSNGAIAWSN

QTSFTCQDIFKETNATYPSSDVPCDATLTEKSFETDMNLNFQNLLVIVLR

ILLLKVAGFNLLMTLRLWSSRAKRSGSGATNFSLLKQAGDVEENPGPMHI

GLLCCVAFSLLWASPVNAGVTQTPKFQVLKTGQSMTLQCAQDMNHNSMYW

YRQDPGMGLRLIYYSASEGTTDKGEVPNGYNVSRLNKREFSLRLESAAPS

QTSVYFCASIGGFEAFFGQGTRLTVVEDLRNVTPPKVSLFEPSKAEIANK

QKATLVCLARGFFPDHVELSWWVNGKEVHSGVCTDPQAYKESNYSYCLSS

RLRVSATFWIINPRNHFRCQVQFHGLSEEDKWPEGSPKPVTQNISAEAWG

RADCGITSASYQQGVLSATILYEILLGKATLYAVLVSTLVVMAMVKRKNS

The statistics for TCR 4266-TCR1 of Patient 4266 are set forth in Table 38 below.

TABLE 38

| Parameter | # | Frequency |
|---|---|---|
| Total wells | 96 | 100% |
| CDR3alpha | 9 | 9.4% |
| CDR3beta | 10 | 10.4% |
| 4266-TCR1 pairs | 9 | 9.4% |
| Total paired TCRs | 53 | 55.2% |

The sequence of 4266-TCR2, which was isolated from Patient 4266, is set forth below. Starting from the amino terminus, the first underlined region is the CDR1alpha (SEQ ID NO: 107), the second underlined region is the CDR2alpha (SEQ ID NO: 108), the third underlined region is the CDR3alpha (SEQ ID NO: 109), the fourth underlined region is the CDR1beta (SEQ ID NO: 110), the fifth underlined region is the CDR2beta (SEQ ID NO: 111), and the sixth underlined region is the CDR3beta (SEQ ID NO: 112). The bold region is the linker (SEQ ID NO: 26). Starting from the amino terminus, the first italicized region is the alpha chain constant region (SEQ ID NO: 23) and the second italicized region is the beta chain constant region (SEQ ID NO: 25). The alpha chain variable region (SEQ ID NO: 113) includes the sequence starting from the amino terminus and ending immediately prior to the start of the alpha chain constant region. The beta chain variable region (SEQ ID NO: 114) includes the sequence starting immediately after the linker and ending immediately prior to the start of the beta chain constant region. The full-length alpha chain (SEQ ID NO: 115) includes the sequence starting from the amino terminus and ending immediately prior to the start of the linker. The full-length beta chain (SEQ ID NO: 116) includes the sequence starting immediately after the linker and ending with the carboxyl terminus.

Cancer reactive T cells were identified using the screening method set forth below. The method used to isolate the TCR is set forth below.

TCR name: 4266-TCR2
Recognition of p53 mutation: R248W
Screening method: p53 "hotspot" mutation universal screening
Co-culture to identify TCR: Co-culture 4266-F1, 4266-F3, 4266-F5 and 4266-F6 with p53mutTMG or R248W long peptide (both co-cultures detected the same TCR), sorted CD8+41BB+ T cells
Method to identify TCR: single-cell RT-PCR
Abundance of TCR amongst all paired TCRs: 24.5% (observed 13 times of 53 pairs)
TCR orientation: alpha-beta
Expression vector: SB transposon (SEQ ID NO: 584)
MAGVFLLYVSMKMGGTTGQNIDQPTEMTATEGAIVQINCTY<u>QTSGFNGLF</u>
WYQQHAGEAPTFLS<u>YNVLDGL</u>EEKGRFSSFLSRSKGYSYLLLKELQMKDS
ASYL<u>CAVYTGGFKTI</u>FGAGTRLFVKANI*QNPEPAVYQLKDPRSQDSTLCL*
*FTDFDSQINVPKTMESGTHIDKCVLDMKAMDSKSNGAIAWSNQTSFTCQD*
*IFKETNATYPSSDVPCDATLTEKSFETDMNLNFQNLLVIVLRILLLLKVAG*
*FNLLMTLRLWSS*RAKRSGSGATNFSLLKQAGDVEENPGPMHTRLLCWAAL
CLLGAELTEAGVAQSPRYKIIEKRQSVAFWCNPI<u>SGHATL</u>YWYQQILGQG
PKLLIQ<u>FQNNGV</u>VDDSQLPKDRFSAERLKGVDSTLKIQPAKLEDSAVYL<u>C</u>
<u>ASNLGGGSTDTQY</u>FGPGTRLTV*LEDLRNVTPPKVSLFEPSKAEIANKQKA*
*TLVCLARGFFPDHVELSWWVNGKEVHSGVCTDPQAYKESNYSYCLSSRLR*
*VSATFWIINPRNHFRCQVQFHGLSEEDKWPEGSPKPVTQNISAEAWGRAD*
*CGITSASYQQGVLSATILYEILLGKATLYAVLVSTLVVMAMVKRKNS*

The statistics for TCR 4266-TCR2 of Patient 4266 are set forth in Table 39 below.

TABLE 39

| Parameter | # | Frequency |
|---|---|---|
| Total wells | 96 | 100% |
| CDR3alpha | 21 | 21.9% |
| CDR3beta | 18 | 18.8% |
| 4266-TCR2 pairs | 13 | 13.5% |
| Total paired TCRs | 53 | 55.2% |

The sequence of 4266-TCR3, which was isolated from Patient 4266, is set forth below. Starting from the amino terminus, the first underlined region is the CDR1alpha (SEQ ID NO: 117), the second underlined region is the CDR2alpha (SEQ ID NO: 118), the third underlined region is the CDR3alpha (SEQ ID NO: 119), the fourth underlined region is the CDR1beta (SEQ ID NO: 120), the fifth underlined region is the CDR2beta (SEQ ID NO: 121), and the sixth underlined region is the CDR3beta (SEQ ID NO: 122). The bold region is the linker (SEQ ID NO: 26). Starting from the amino terminus, the first italicized region is the alpha chain constant region (SEQ ID NO: 23) and the second italicized region is the beta chain constant region (SEQ ID NO: 25). The alpha chain variable region (SEQ ID NO: 123) includes the sequence starting from the amino terminus and ending immediately prior to the start of the alpha chain constant region. The beta chain variable region (SEQ ID NO: 124) includes the sequence starting immediately after the linker and ending immediately prior to the start of the beta chain constant region. The full-length alpha chain (SEQ ID NO: 125) includes the sequence starting from the amino terminus and ending immediately prior to the start of the linker. The full-length beta chain (SEQ ID NO: 126) includes the sequence starting immediately after the linker and ending with the carboxyl terminus.

Cancer reactive T cells were identified using the screening method set forth below. The method used to isolate the TCR is set forth below.

TCR name: 4266-TCR3
Recognition of p53 mutation: R248W
Screening method: p53 "hotspot" mutation universal screening
Co-culture to identify TCR: Co-culture 4266-F1, 4266-F3, 4266-F5 and 4266-F6 with p53mutTMG or R248W long peptide (both co-cultures detected the same TCR), sorted CD8+41BB+ T cells
Method to identify TCR: single-cell RT-PCR
Abundance of TCR amongst all paired TCRs: 34.0% (observed 18 times of 53 pairs)
TCR orientation: alpha-beta
Expression vector: SB transposon (SEQ ID NO: 585)
MAGVFLLYVSMKMGGTTGQNIDQPTEMTATEGAIVQINCTY<u>QTSGFNGLF</u>
WYQQHAGEAPTFLS<u>YNVLDGL</u>EEKGRFSSFLSRSKGYSYLLLKELQMKDS
ASYL<u>CAFYYGGSQGNLI</u>FGKGTKLSVKPNI*QNPEPAVYQLKDPRSQDSTL*
*CLFTDFDSQINVPKTMESGTFITDKCVLDMKAMDSKSNGAIAWSNQTSFT*
*CQDIFKETNATYPSSDVPCDATLTEKSFETDMNLNFQNLLVIVLRILLLK*
*VAGFNLLMTLRLWSS*RAKRSGSGATNFSLLKQAGDVEENPGPMHTRUCWV
VLGFLGTDHTGAGVSQSPRYKVAKRGQDVALRCDPI<u>SGHVS</u>LFWYQQALG
QGPEFLTY<u>FQNEAQ</u>LDKSGLPSDRFFAERPEGSVSTLKIQRTQQEDSAVY
LC<u>ASSFGSGSTDTQY</u>FGPGTRLTV*LEDLRNVITPKVSLFEPSKAELINKQ*
*KATLVCLARGFFPDHVELSWWVNGKEVHSGVCTDPQAYKESNYSYCLSSR*
*LRVSATFWHNPRNHFRCQVQFHGLSEEDKWPEGSPKPVTQNISAEAWGRA*
*DCGITSASYQQGVLSATILYEILLGKATLYAVLVSTLVVMAMVKRKNS*

The statistics for TCR 4266-TCR3 of Patient 4266 are set forth in Table 40 below.

TABLE 40

| Parameter | # | Frequency |
|---|---|---|
| Total wells | 96 | 100% |
| CDR3alpha | 19 | 19.8% |
| CDR3beta | 26 | 27.1 |
| 4266-TCR3 pairs | 18 | 18.8% |
| Total paired TCRs | 53 | 55.2% |

The sequence of 4266-TCR4, which was isolated from Patient 4266, is set forth below. Starting from the amino terminus, the first underlined region is the CDR1alpha (SEQ ID NO: 127), the second underlined region is the CDR2alpha (SEQ ID NO: 128), the third underlined region is the CDR3alpha (SEQ ID NO: 129), the fourth underlined region is the CDR1beta (SEQ ID NO: 130), the fifth underlined region is the CDR2beta (SEQ ID NO: 131), and the sixth underlined region is the CDR3beta (SEQ ID NO: 132). The bold region is the linker (SEQ ID NO: 26). Starting from the amino terminus, the first italicized region is the alpha chain constant region (SEQ ID NO: 23) and the second italicized region is the beta chain constant region (SEQ ID NO: 25). The alpha chain variable region (SEQ ID NO: 133) includes the sequence starting from the amino terminus and ending immediately prior to the start of the alpha chain constant region. The beta chain variable region (SEQ ID NO: 134) includes the sequence starting immediately after the linker and ending immediately prior to the start of the beta chain constant region. The full-length alpha chain (SEQ ID NO: 135) includes the sequence starting from the amino terminus and ending immediately prior to the start of the linker. The full-length beta chain (SEQ ID NO: 136) includes the sequence starting immediately after the linker and ending with the carboxyl terminus.

Cancer reactive T cells were identified using the screening method set forth below. The method used to isolate the TCR is set forth below.

TCR name: 4266-TCR4
Recognition of p53 mutation: R248W
Screening method: p53 "hotspot" mutation universal screening
Co-culture to identify TCR: Co-culture 4266-F1, 4266-F3, 4266-F5 and 4266-F6 with p53mutTMG or R248W long peptide (both co-cultures detected the same TCR), sorted CD8+41BB+ T cells
Method to identify TCR: single-cell RT-PCR
Abundance of TCR amongst all paired TCRs: 9.4% (observed 5 times of 53 pairs)
TCR orientation: alpha-beta
Expression vector: SB transposon (SEQ ID NO: 586)
MAGVFLLYVSMKMGGTTGQNIDQPTEMTATEGAIVQINCTYQTSGFNGLF
WYQQHAGEAPTFLSYNVLDGLEEKGRFSSFLSRSKGYSYLLLKELQMKDS
ASYLCAVYPGGSQGNLIFGKGTKLSVKP*NIQNPEPAVYQLKDPRSQDSTL*
*CLFTDFDSQINVPKTMESGTFITDKCVLDMKAMDSKSNGAIAWSNQTSFT*
*CQDIFKETNATYPSSDVPCDATLTEKSFETDMNLNFQNLLVIVLRILLLK*
*VAGFNLLMTLRLWSS*RAKRSGSGATNFSLLKQAGDVEENPGPMHTRLLCW
AALCLLGAELTEAGVAQSPRYKIIEKRQSVAFWCNPISGHATLYWYQQIL
GQGPKLLIQFQNNGVVDDSQLPKDRFSAERLKGVDSTLKIQPAKLEDSAV
YLCASSLGTGSTDTQYFGPGTRLTV*LEDLRNVTPPKVSLFEPSKAEIANK*
*QKATLVCLARGFFPDHVELSWWVNGKEVHSGVCTDPQAYKESNYSYCLSS*
*RLRVSATFWHNPRNHFRCQVQFHGLSEEDKWPEGSPKPVTQNISAEAWGR*
*ADCGITSASYQQGVLSATILYEILLGKATLYAVLVSTLVVMAMVKRKNS*

The statistics for TCR 4266-TCR4 of Patient 4266 are set forth in Table 41 below.

TABLE 41

| Parameter | # | Frequency |
|---|---|---|
| Total wells | 96 | 100% |
| CDR3alpha | 5 | 5.2% |
| CDR3beta | 13 | 13.5 |
| 4266-TCR3 pairs | 5 | 5.2% |
| Total paired TCRs | 53 | 55.2% |

Example 10

This example demonstrates a summary of responses to p53 "hotspot" mutations by T cells.

A summary of responses to p53 "hotspot" mutations by T cells is provided in Table 42. Numbers 1-15 of Table 42 were a retrospective study. Numbers 16-33 of Table 42 were a prospective study.

TABLE 42

| # | Tumor type | Patient | p53 mut | T cell screen | HLA |
|---|---|---|---|---|---|
| 1 | Gastric | 3446 | G245S | n/a | n/a |
| 2 | Gastroesophageal | 3788 | Y220C | N | n/a |
| 3 | Rectal | 3942 | R273C | n/a | n/a |
| 4 | Colon | 4023 | R282W | Y | Class-II |
| 5 | Colon | 4095 | R282W | n/a | n/a |
| 6 | Ovarian | 4127 | G245S | Y | DRB3*02:02 |
| 7 | Breast | 4130 | R273H | Y | Class-II |
| 8 | Colon | 4141 | R175H | Y | A*02:01 |
| 9 | Ovarian | 4149 | Y220C | Y | DRB3*02:02 |
| 10 | Colon | 4160 | R273H | N | n/a |
| 11 | Melanoma | 4165 | G245D | N | n/a |
| 12 | Colon | 4166 | R248W | n/a | n/a |
| 13 | Rectal | 4171 | R248Q | N | n/a |
| 14 | Melanoma | 4187 | R273H | N | n/a |
| 15 | Colon | 4196 | R175H | Y | A*02:01 |
| 16 | Colon | 4213 | R248Q | Y | both |
| 17 | Colon | 4217 | R175H | N | n/a |
| 18 | Cholangio-carcinoma | 4220 | R248Q | N | n/a |
| 19 | Rectal | 4235 | R273C | N | n/a |
| 20 | Colon | 4238 | R248Q | Y | Class-I |
| 21 | Colon | 4244 | R282W | N | n/a |
| 22 | Colon | 4245 | R248Q | N | n/a |
| 23 | Colon | 4252 | R175H | N | n/a |
| 24 | Melanoma | 4253 | R248W | Y | unknown |
| 25 | Colon | 4254 | R273H | N | n/a |
| 26 | Colon | 4257 | R248W | N | n/a |
| 27 | Endometrial | 4258 | R273H | N | n/a |
| 28 | Colon | 4259 | Y220C | Y | A*02.01, DRB1*04 |
| 29 | Colon | 4266 | R248W | Y | A*68:01 |
| 30 | Colon | 4268 | R248Q | Y | both |
| 31 | Pancreatic | 4270 | R282W | Y | unknown |
| 32 | Rectal | 4273 | R248W | Y | DPB1*02:01 |
| 33 | Rectal | 4274 | R175H | n/a | |
| 34 | Colon | 4283 | R175H | N | n/a |
| 35 | Colon | 4285 | R175H | Y | DRB1*13:01 |
| 36 | Colon | 4287 | R248W | N | n/a |
| 37 | Colon | 4312 | R175H | N | n/a | n/a = not applicable; N = negative; Y = confirmed reactive; TBS = to be screened.

Example 11

This example demonstrates the treatment of patients with p53 mutation-reactive TIL.

A summary of the treatment of patients with p53 mutation-reactive TIL is provided in Table 43.

TABLE 43

| # | Tumor Type | Patient | p53 mut | Infusion bag screening | Total # of Cells (×10⁹) | % of p53 reactive TIL | # of p53 reactive TIL (×10⁹) | Response | Duration (months) |
|---|---|---|---|---|---|---|---|---|---|
| 1 | Ovarian | 4127 | G245S | Y | 143 | 2.8 | 4.0 | P.R. | 4 |
| 2 | Colon | 4141 | R175H | Y | 69 | 0.8 | 0.6 | N.R. | — |
| 3 | Colon | 4196 | R175H | Y | 92 | 3.3 | 3.0 | N.R. | — |
| 4 | Ovarian | 4149 | Y220C | Y | 37 | 11.1 | 4.1 | N.R. | — |
| 5 | Colon | 4213 | R248Q | TBS | 33 | | | P.R. | 4 |
| 6 | Colon | 4238 | R248Q | TBS | 57 | | | N.R. | |
| 7 | Colon | 4266 | R248W | Y | 104 | 50.8 | 52.8 | | |
| 8 | Colon | 4268 | R248Q | **TBS | | | | | |
| 9 | Rectal | 4273 | R248W | **Y | 117 | 6.8 | 8.0 | N.R. | — |
| 10 | Colon | 4285 | R175H | Y | 69.6 | 2.4 | 1.7 | N.R. | — |

NT = not treated; TBS = to be screened; N.R. = no response; P.R. = partial response;
**patient not yet treated.

Example 12

This example demonstrates the isolation and specific reactivity of a TCR from patient 4141.

Autologous APCs were transfected with TMG encoding irrelevant mutations, WT p53 sequence, or mutated p53 sequence including R175H. Media alone and PMA and ionomycin were negative and positive controls, respectively. The following day, TIL from patient 4141 (fragment culture 12) were co-cultured overnight at 37° C. with TMG-transfected APCs. Secretion of IFN-γ was evaluated by ELISPOT. Expression of 4-1BB was evaluated by flow cytometry after gating for lymphocytes→living cells (PI negative)→CD3+(T cells)→CD4−CD8+. The results are shown in FIG. 38.

Cos 7 cells (2.5×10⁴ per well) were plated on wells of flat-bottom 96 well plates. The following day, cells were co-transfected with individual HLA alleles from patient 4141 and either no extra gene, WT TP53 TMG, or mutated TP53 TMG containing the p53-R175H sequence. TIL with specificity to p53-R175H from Patient 4141 (fragment culture 12) were co-cultured the following day with transfected Cos 7 cells and were incubated overnight at 37° C. Secretion of IFN-γ was evaluated by ELISPOT. The results are shown in FIG. 39.

T cells expressing mock (no TCR) or 4141-TCR1a2 were co-cultured with T2 tumor cells (expressing HLA-A*02:01). T2 cells were pulsed for 2 hours at 37° C. with peptide vehicle (DMSO) or purified (>95% by HPLC) peptides composed of WT p53-R175 peptide HMTEVVRRC (SEQ ID NO: 532) or mutated p53-R175H peptide HMTEVVRHC (SEQ ID NO: 530). Media alone and PMA and Ionomycin were negative and positive controls, respectively. Co-cultures were performed overnight at 37° C. Secretion of IFN-γ was evaluated by ELISA. The results are shown in FIG. 40.

T cells expressing 4141-TCR1a2 were co-cultured overnight at 37° C. with Saos2 cells (p53-NULL and HLA-A*02:01+), which were either unmanipulated or made to overexpress full length p53-R175H protein. Inhibitors of secretion (monensin and brefeldin A) were added to co-cultures to trap cytokines within T cells. After 6 hours of co-culture, cells were fixed and permeabilized then stained for IL-2, CD107a, IFN-γ and tumor necrosis factor-alpha (TNFα). Flow cytometry was used to analyze co-cultures based on a lymphocyte gate. The results are shown in FIG. 41.

The sequence of TCR 4141-TCR1a2, which was isolated from Patient 4141, is set forth below. Starting from the amino terminus, the first underlined region is the CDR1alpha (SEQ ID NO: 467), the second underlined region is the CDR2alpha (SEQ ID NO: 468), the third underlined region is the CDR3alpha (SEQ ID NO: 469), the fourth underlined region is the CDR1beta (SEQ ID NO: 470), the fifth underlined region is the CDR2beta (SEQ ID NO: 471), and the sixth underlined region is the CDR3beta (SEQ ID NO: 472). The bold region is the linker (SEQ ID NO: 26). Starting from the amino terminus, the first italicized region is the alpha chain constant region (SEQ ID NO: 23) and the second italicized region is the beta chain constant region (SEQ ID NO: 25). The alpha chain variable region (SEQ ID NO: 473) includes the sequence starting from the amino terminus and ending immediately prior to the start of the alpha chain constant region. The beta chain variable region (SEQ ID NO: 474) includes the sequence starting immediately after the linker and ending immediately prior to the start of the beta chain constant region. The full-length alpha chain (SEQ ID NO: 475) includes the sequence starting from the amino terminus and ending immediately prior to the start of the linker. The full-length beta chain (SEQ ID NO: 476) includes the sequence starting immediately after the linker and ending with the carboxyl terminus.

Cancer reactive T cells were identified as described below. The TCR was isolated as described below.

TCR name: 4141-TCR1a2

Recognition of p53 mutation: R175H

Screening method: p53 "hotspot" mutation universal screening

Co-culture to identify TCR: Co-culture 4141 infusion bag TIL with p53mutTMG and sorted CD8+41BB+ T cells Method to identify TCR: single-cell RT-PCR then TA TOPO cloning kit (Thermo Fisher Scientific, Waltham, MA) for alpha chain TCR orientation: alpha-beta Expression vector: SB transposon (SEQ ID NO: 587)
MASIRAVFIFLWLQLDLVNGENVEQHPSTLSVQEGDSAVIKCTYS<u>DSASN</u>

<u>YFPWYKQELGKGPQUID</u>IRSNVGEKKDQRIAVTLNKTAKHFSLHITETOP

EDSAVYF<u>CAASKSAIMVVLQTSSS</u>LELALCLLSSQV*NIQNPEPAVYQLKD*

*PRSQDSTLCLFTDFDSQINVPKTMESGTFITDKCVLDMKAMDSKSNGAIA*

*WSNQTSFTCQDIFKETNATYPSSDVPCDATLTEKSFETDMNLNFQNLLVI*

*VLRILLLKVAGFNLLMTLRLWSS*RAKRSGSGATNFSLLKQAGDVEENPGP

MHPQLLGYVVLCLLGAGPLEAQVTQNPRYLITVTGKKLTVTCSON<u>MNHEY</u>

<u>MSWYRQDPGLGLRQIYY</u>SMNVEVTDKGDVPEGYKVSRKEKRNFPLILESP

SPNQTSLYF<u>CASSIQQGADTQYFGPGTRLTVL</u>*EDLRNVTPPKVSLFEPSK*

*AEIANKQKATLVCLARGFFPDHVELSWWVNGKEVHSGVCTDPQAYKESNY*

*SYCLSSRLRVSATFWHNPRNHFRCQVQFHGLSEEDKWPEGSPKPVTQNIS*

*AEAWGRADCGITSASYQQGVLSATILYEILLGKATLYAVLVSTLVVMAMV*

*KRKNS*

The statistics for 4141-TCR1a2 from patient 4141 are set forth in Table 44 below.

TABLE 44

| Parameter | # | Frequency |
| --- | --- | --- |
| Total wells | 96 | 100% |
| CDR3alpha | Unknown (TA TOPO cloning) | Not applicable |
| CDR3beta | 58 | 60.4% |

Example 13

This example demonstrates the isolation and specific reactivity of a TCR isolated from patient 4259.

TIL fragment culture (no. 6) from patient 4259 was co-cultured with autologous APCs either (1) electroporated with TMG composed of irrelevant, WT p53, or mutated p53 sequence or (2) pulsed with peptide vehicle (DMSO) or purified (>95% by HPLC) 25-amino acid peptides composed of WT p53-Y220 sequence or mutated p53-Y220C sequence. Co-cultures were performed overnight at 37° C. Expression of 4-1BB was evaluated by flow cytometry after gating for lymphocytes→living cells (PI negative)→CD3+(T cells). The results are shown in FIG. 42.

Autologous APCs were pulsed with decreasing concentrations of 25-amino acid peptides corresponding to the WT p53-Y220 or mutated p53-Y220C sequence for 2 hours at 37° C. TIL fragment culture (no. 6) from patient 4259 was co-cultured with peptide-pulsed APCs. Expression of 4-1BB was assayed by flow cytometry after gating lymphocytes→living cells (P1 negative)→CD3+ (T cells). The results are shown in FIG. 43.

Autologous antigen presenting cells were pulsed with DMSO, WT p53-Y220 peptide RNTFRHSVVVPYE (SEQ ID NO: 533) or mutated p53-Y220C peptide RNTFRHSVVVPCE (SEQ ID NO: 534) for 2 hours at 37° C. Excess peptide was washed away. TIL from patient 4259 (fragment culture 6) with specificity to p53-Y220C was co-cultured overnight at 37° C. with peptide-pulsed APCs. Expression of 4-1 BB was evaluated by flow cytometry after gating for lymphocytes→living cells (PI negative)→CD3+ (T cells). The results are shown in FIG. 44.

Cos 7 cells (2.5×10⁴ per well) were plated on wells of flat-bottom 96 well plates. The following day, cells were co-transfected with individual HLA alleles from patient 4259. The next day, DMSO or the p53-Y220C peptide RNTFRHSVVVPCE (SEQ ID NO: 534) were pulsed for 2 hours on transfected Cos 7 cells. Excess peptide was washed away. TIL fragment culture no. 6 from Patient 4259 was added (10⁵ cells/well). Co-cultures were incubated overnight at 37° C. Expression of 4-1BB was assayed by flow cytometry after gating lymphocytes→live→CD3+ (T cells)→ CD8−CD4+. The results are shown in FIG. 45.

APCs autologous to Patient 4259 were pulsed with 25-amino acid peptides corresponding to the WT p53-Y220 or mutated p53-Y220C sequence for 2 hours at 37° C. Excess peptide was washed away. T cells expressing 4259-F6-TCR were co-cultured overnight at 37° C. with peptide-pulsed APCs. Expression of 4-1BB was evaluated by flow cytometry after gating for lymphocytes→living cells (PI negative)→CD3+ (T cells). The introduced TCR was measured by mouse TCRbeta (mTCR). The results are shown in Table 45.

TABLE 45

|  | WT p53-Y220 | Mut p53-Y220C |
| --- | --- | --- |
| 4-1BB+/mTCR+ | 0.27 | 5.22 |
| 4-1BB−/mTCR− | 68.5 | 73.7 |
| 4-1BB+/mTCR− | 0.18 | 1.59 |
| 4-1BB−/mTCR+ | 31.0 | 19.5 |

A tumor cell (TC) line was established from a xenografted tumor fragment resected from Patient 4259 and then serially passaged through immunocompromised mice (TC #4259). TC #4259 was co-cultured with T cells (10⁵) expressing mock (no TCR) or p53-Y220C-specific TCR (4259-F6-TCR) overnight at 37° C. The TC #4259 cells were either incubated with nothing, W6/32 pan-HLA Class-1 specific blocking antibody, IVA12 pan-HLA Class-II specific blocking antibody or mutated p53-Y220C peptide RNTFRHSVVVPCE (SEQ ID NO: 534) for 2 hours at 37° C. The antibodies were kept in the co-culture at 5 µg/mL final concentration. The peptide was incubated at 10 µg/mL and excess peptide was washed after incubation. Media alone (no TC) and PMA and Ionomycin were negative and positive controls, respectively. Expression of 4-1BB was evaluated by flow cytometry after gating for lymphocytes→living cells (PI negative)→CD3+ (T cells). The results are shown in FIG. 46.

The sequence of TCR 4259-F6-TCR, which was isolated from Patient 4259, is set forth below. Starting from the amino terminus, the first underlined region is the CDR1alpha (SEQ ID NO: 477), the second underlined region is the CDR2alpha (SEQ ID NO: 478), the third underlined region is the CDR3alpha (SEQ ID NO: 479), the fourth underlined region is the CDR1beta (SEQ ID NO: 480), the fifth underlined region is the CDR2beta (SEQ ID NO: 481), and the sixth underlined region is the CDR3beta (SEQ ID NO: 482). The bold region is the linker (SEQ ID NO: 26). Starting from the amino terminus, the first italicized region is the alpha chain constant region (SEQ ID NO: 23) and the second italicized region is the beta chain constant region (SEQ ID NO: 25). The alpha chain variable region (SEQ ID NO: 483) includes the sequence starting from the amino terminus and ending immediately prior to the start of the alpha chain constant region. The beta chain variable region (SEQ ID NO: 484) includes the sequence starting immediately after the linker and ending immediately prior to the start of the beta chain constant region. The full-length alpha chain (SEQ ID NO: 485) includes the sequence starting from the amino terminus and ending immediately prior to the start of the linker. The full-length beta chain (SEQ ID NO: 486) includes the sequence starting immediately after the linker and ending with the carboxyl terminus.

Cancer reactive T cells were identified as described below. The TCR was isolated as described below.
  TCR name: 4259-F6-TCR
  Recognition of p53 mutation: Y220C
  Screening method: p53 "hotspot" mutation universal screening
  Co-culture to identify TCR: Co-culture 4259-F6 with p53-Y220C peptide and sorted CD4+41BB+ T cells
  Method to identify TCR: single-cell RT-PCR
  Abundance of TCR amongst all paired TCRs: 81.1% (observed 36 times of 44 pairs)
  TCR orientation: alpha-beta
  Expression vector: SB transposon (SEQ ID NO: 588)
MASLRVLLVILWLQLSWVWSQQKEVEQNSGPLSVPEGAIASLNCTYS<u>DRG
SQSFFWYRQYSGKSPELIMF</u>IYSNGDKEDGRFTAQLNKASQYVSLLIRDS
QPSDSATYL<u>CAWNSGGSNYKLT</u>FGKGTLLTVNP*NIQNPEPAVYQLKDPRS
QDSTLCLFTDFDSQINVPKTMESGTFITDKCVLDMKAMDSKSNGAMWSNQ
TSFTCQDIFKETNATYPSSDVPCDATLTEKSFETDMNLNFQNLLVIVLRI
LLLKVAGFNLLMTLRLWSSRAKRSGSGATNFSLLKQAGDVEENPGPMHLG
LLCCGAFSLLWAGPVNAGVTQTPKFRVLKTGQSMTLLCAQD<u>MNHEYMYWY
RQDPGMGLRLIHY</u>SVGEGTTAKGEVPDGYNVSRLKKQNFLLGLESAAPSQ
TSVYF<u>CASSYSQAWGQPQHF</u>GDGTRLSILEDLRNVTPPKVSLFEPSKAEI
ANKQKATLVCLARGFFPDHVELSWWVNGKEVHSGVCTDPQAYKESNYSYC
LSSRLRVSATEWHNPRNHFRCQVQFHGLSEEDKWPEGSPKPVTQNISAEA
WGRADCGITSASYQQGVLSATILYEILLGKATLYAVLVSTLVVMAMVKRK
NS*

The statistics for 4259-F6-TCR from patient 4259 are set forth in Table 46 below.

TABLE 46

| Parameter | # | Frequency |
|---|---|---|
| Total wells | 96 | 100% |
| CDR3alpha | 41 | 42.7% |
| CDR3beta | 47 | 49.0% |
| 4259-F6-TCR pairs | 36 | 37.5% |
| Total paired TCRs | 44 | 45.8% |

Example 14

This example demonstrates the isolation and specific reactivity of a TCR from patient 4285.

TIL fragments (F1-F22 and F24, n=23) from patient 4285 were co-cultured with autologous APCs electroporated with TMG composed of irrelevant, WT p53, or mutated p53 sequence. Co-cultures were performed overnight at 37° C. Secretion of IFN-γ was evaluated using ELISPOT assay. The results are shown in FIG. 47. Expression of 4-1BB was evaluated by flow cytometry after gating for lymphocytes→living cells (PI negative)→CD3+ (T cells). The results are shown in FIG. 49.

TIL fragments (F1-F22 and F24, n=23) from patient 4285 were co-cultured with autologous APCs pulsed with peptide vehicle (DMSO) or purified (>95% by HPLC) 25-amino acid peptides composed of WT p53-R175 sequence or mutated p53-R175H sequence. Co-cultures were performed overnight at 37° C. Secretion of IFN-γ was evaluated using ELISPOT assay. The results are shown in FIG. 48. Expression of 4-1BB was evaluated by flow cytometry after gating for lymphocytes→living cells (PI negative)→CD3+ (T cells). The results are shown in FIG. 50. TIL fragment F6 was the source of 4285-TCR 1 after sorting CD4+41BB+ T cells.

Autologous APCs were pulsed with 15-amino acid peptides from the p53-R175H sequence (amino acid substitution underlined in Table 45) overlapping 14 amino acids. TIL from patient 4285 (fragment cultures 10, 6 and 9) with specificity to p53-R175H were co-cultured overnight at 37° C. with peptide-pulsed APCs. DMSO was peptide vehicle. Secretion of IFN-7 was evaluated using ELISPOT assay. The results are shown in Table 47.

TABLE 47

| | | ELISPOT Result Positive (+) or negative (-) for IFN-y production | | |
|---|---|---|---|---|
| Peptide | SEQ ID NO: | 4285-F10 | 4285-F6 | 4285-F9 |
| None (vehicle) | Not applicable | - | - | - |
| YKQSQHMTEVVR<u>H</u>CP | 519 | - | - | - |
| KQSQHMTEVVR<u>H</u>CPH | 520 | - | - | + |
| QSQHMTEVVR<u>H</u>CPHH | 521 | - | + | + |
| SQHMTEVVR<u>H</u>CPHHE | 522 | + | + | + |
| QHMTEVVR<u>H</u>CPHHER | 523 | + | + | + |
| HMTEVVR<u>H</u>CPHHERC | 524 | + | + | + |
| MTEVVR<u>H</u>CPHHERCS | 525 | + | + | + |
| TEVVR<u>H</u>CPHHERCSD | 526 | + | + | |

TABLE 47-continued

| | | ELISPOT Result Positive (+) or negative (-) for IFN-γ production | | |
|---|---|---|---|---|
| Peptide | SEQ ID NO: | 4285-F10 | 4285-F6 | 4285-F9 |
| EVVRHCPHHERCSDS527 | | + | + | + |
| VVRHCPHHERCSDSD528 | | + | + | − |
| VRHCPHHERCSDSDG529 | | + | + | − |

Cos 7 cells ($2.5 \times 10^4$ per well) were plated on wells of flat-bottom 96 well plates. The following day, cells were co-transfected with individual HLA alleles from patient 4285. The next day cells were pulsed with DMSO or mutated p53-R175H peptide YKQSQHMTE-VVRHCPHHERCSDSDG (SEQ ID NO: 2) for 2 hours at 37° C. at 10 μg/mL. Selected TIL fragment cultures with specificity to p53-R175H from Patient 4285 (4285-F6, 4285-F9 and 4285-F10) were co-cultured with transfected Cos 7 cells overnight at 37° C. Expression of 4-1BB was assayed by flow cytometry after gating lymphocytes→live→CD3+ (T cells)→CD8−CD4+. The results are shown in FIG. 51.

Autologous APCs were pulsed with decreasing concentrations of 25- or 15-amino acid peptides corresponding to the WT or mutated p53-R175H sequence for 2 hours at 37° C. T cells transposed with 4285-TCR1 from patient 4285 were co-cultured overnight at 37° C. with peptide-pulsed APCs. Expression of 4-1BB was assayed by flow cytometry after gating lymphocytes→live→CD3+ (T cells)→CD8−CD4+. The results are shown in FIG. 52.

The sequence of 4285-TCR1, which was isolated from Patient 4285, is set forth below. Starting from the amino terminus, the first underlined region is the CDR1alpha (SEQ ID NO: 487), the second underlined region is the CDR2alpha (SEQ ID NO: 488), the third underlined region is the CDR3alpha (SEQ ID NO: 489), the fourth underlined region is the CDR1beta (SEQ ID NO: 490), the fifth underlined region is the CDR2beta (SEQ ID NO: 491), and the sixth underlined region is the CDR3beta (SEQ ID NO: 492). The bold region is the linker (SEQ ID NO: 26). Starting from the amino terminus, the first italicized region is the alpha chain constant region (SEQ ID NO: 23) and the second italicized region is the beta chain constant region (SEQ ID NO: 25). The alpha chain variable region (SEQ ID NO: 493) includes the sequence starting from the amino terminus and ending immediately prior to the start of the alpha chain constant region. The beta chain variable region (SEQ ID NO: 494) includes the sequence starting immediately after the linker and ending immediately prior to the start of the beta chain constant region. The full-length alpha chain (SEQ ID NO: 495) includes the sequence starting from the amino terminus and ending immediately prior to the start of the linker. The full-length beta chain (SEQ ID NO: 496) includes the sequence starting immediately after the linker and ending with the carboxyl terminus.

Cancer reactive T cells were identified as described below. The TCR was isolated as described below.

TCR name: 4285-TCR1
Recognition of p53 mutation: R175H
Screening method: p53 "hotspot" mutation universal screening
Co-culture to identify TCR: Co-culture 4285-F6 with p53-R175H peptide and sorted CD4+41BB+ T cells
Method to identify TCR: single-cell RT-PCR
Abundance of TCR amongst all paired TCRs: 81.8% (observed 36 times of 44 pairs)
TCR orientation: alpha-beta
Expression vector: SB transposon (SEQ ID NO: 589)
MAKNPLAAPLLILWFHLDCVSSILNVEQSPQSLHVQEGDSTNFTCSFP<u>SS</u>

<u>NFYALHWYRWETAKS</u>PEALFV<u>MTLNGDEKKK</u>GRISATLNTKEGYSYLYIK

GSQPEDSATYL<u>CALITGGGNKLT</u>FGTGTQLKVEL*NIQNPEPAVYQLKDPR*

*SQDSTLCLFTDFDSQINVPKTMESGTFITDKCVLDMKAMDSKSNGAIAWS*

*NQTSFTCQDIEKETNATYPSSDVPCDATLTEKSFETDMNLNFQNLLVIVL*

*RILLLKVAGFNLLMTLRLWSS*RAKRSGSGATNFSLLKQAGDVEENPGPMH

LGLLCCGAFSLLWAGPVNAGVTQTPKFRVLKTGQSMTLLCAQD<u>MNHEYMY</u>

WYRQDPGMGLRLIHY<u>SVGEGTT</u>AKGEVPDGYNVSRLKKQNFLLGLESAAP

SQTSVYF<u>CASRLQGWNSPLHF</u>GNGTRLTVT*EDLRNFTPPKVSLFEPSKAE*

*LINKQKATLVCLARGFFPDHVELSWWVNGKEVHSGVCTDPQAYKESNYSY*

*CLSSRLRVSATFWHNPRNTIFRCQVQFHGLSEEDKWPEGSPKPVTQNISA*

*EAWGRADCGITSASYQQGVLSATILYEILLGKATLYAVLVSTLVVMAMVK*

*RKNS*

The statistics for 4285-TCR1 from patient 4285 are set forth in Table 48.

TABLE 48

| Parameter | # | Frequency |
|---|---|---|
| Total wells | 96 | 100% |
| CDR3alpha | 37 | 39.8% |
| CDR3beta | 39 | 40.6% |
| 4285-TCR1 pairs | 36 | 37.5% |
| Total paired TCRs | 44 | 45.8% |

Example 15

This example demonstrates the specific reactivity of the three anti-mutated p53 TCRs from patient 4196 of Example 2.

The expression of HLA-A*0201 and p53 R175H by various target cell lines is presented in Table 49.

TABLE 49

| Cell line | HLA-A*0201 reported | HLA-A2 by FACS MFI (MFI isotype) | P53 R175H reported | Estimated P53 R175H copy # per 1e5 GAPDH |
|---|---|---|---|---|
| KLE | + | +46733 (2038) | + | 167 |
| SKUT1 | + | −1009 (1009) | + | 308 |
| TYKNU | + | +6556 (1537) | + | 175 |
| TYKNU CpR | + | +8611 (1511) | + | 179 |
| VMRCLCD | + | +8340 (949) | + | 43 |
| SKBR3 | + | weak 3414 (2546) | + | 99 |
| CEM/C1 | − | −387 (330) | + | 138 |
| HCC1395 | − | −1743 (1537) | + | 105 |
| KMS26 | + | +57284 (679) | + | 87 |
| AU565 | + | weak 3839 (1870) | + | 80 |
| LS123 | − | −1916 (2009) | + | 190 |
| CCRF CEM | − | −235 (177) | + | 149 |
| SAOS2 R175H | + | +51049 (1417) | + | N/A |
| SAOS Parental | + | +40003 (1272) | − | 22 (detection limit) |
| media | Not applicable (n/a) | n/a | n/a | n/a |
| PMA/Io | n/a | n/a | n/a | n/a |

The target cells of Table 49 were co-cultured with cells that were transduced with one of the TCRs of Example 2. Mock-transduced cells (no TCR) were used as control effector cells. IFN-γ secretion (pg/mL) (Table 50) and 4-1BB expression (% 4-1BB (of mTCRβ+)) (Table 51) were measured.

TABLE 50

| Cell line | TP53 TCR AV38/BV10 CD8+ | TP53 TCR AV12/BV6 CD8+ | TP53 TCR AV6/BV11 CD8+ | mock TCR |
|---|---|---|---|---|
| KLE | 741 | 110 | 71 | 51 |
| SKUT1 | 28 | 24 | 26 | 38 |
| TYKNU | 196 | 41 | 27 | 33 |
| TYKNU CpR | 298 | 65 | 34 | 24 |
| VMRCLCD | 23 | 22 | 23 | 23 |
| SKBR3 | 26 | 23 | 24 | 26 |
| CEM/C1 | 26 | 23 | 22 | 28 |
| HCC1395 | 25 | 23 | 26 | 24 |
| KMS26 | 472 | 168 | 95 | 23 |
| AU565 | 21 | 30 | 25 | 28 |
| LS123 | 25 | 23 | 25 | 26 |
| CCRF CEM | 23 | 23 | 30 | 30 |
| SAOS2 R175H | >2000 | 1064 | 190 | 24 |
| SAOS Parental | 29 | 26 | 26 | 25 |
| media | 25 | 26 | 26 | 25 |
| PMA/Io | 1166 | 485 | 98 | 161 |

TABLE 51

| Cell line | TP53 TCR AV38/BV10 CD8+ | TP53 TCR AV12/BV6 CD8+ | TP53 TCR AV6/BV11 CD8+ | mock TCR |
|---|---|---|---|---|
| KLE | 91.5 | 80.9 | 84.3 | 2.2 |
| SKUT1 | 2.6 | 2.5 | 2.5 | 8.3 |
| TYKNU | 70.4 | 67.3 | 56.4 | 2.7 |
| TYKNU CpR | 87.7 | 78.5 | 74.7 | 2.8 |
| VMRCLCD | 3.0 | 2.8 | 8.0 | 6.3 |
| SKBR3 | 1.5 | 2.4 | 2.1 | 5.2 |
| CEM/C1 | 2.6 | 3.5 | 5.0 | 4.1 |
| HCC1395 | 1.5 | 2.3 | 3.4 | 2.6 |
| KMS26 | 65.7 | 58.7 | 61.5 | 6.9 |
| AU565 | 2.0 | 2.0 | 2.3 | 5.6 |
| LS123 | 2.0 | 2.7 | 3.2 | 4.6 |
| CCRF CEM | 3.9 | 5.6 | 6.2 | 2.4 |
| SAOS2 R175H | 89.3 | 88.4 | 88.5 | 5.5 |
| SAOS Parental | 2.3 | 0.0 | 11.0 | 5.2 |

Example 16

This example demonstrates a summary of the reactivity of TCRs of Examples 1-15.

The TCRs of Table 52 were isolated, expressed in T cells and tested against the relevant antigen. A summary of the results is shown in Table 52.

TABLE 52

| TCR name | p53 a.a. substitution | TCR tested? | p53 mutation reactive? |
|---|---|---|---|
| 4127-TP53-G245S-TCR1 | G245S | yes | yes |
| 4127-TP53-G245S-TCR4 | G245S | yes | yes |
| 4127_O102_TCR | G245S | yes | yes |
| 4149TCRa2b2 | Y220C | yes | yes |
| 4196_AV12-1_with_BV6-1 | R175H | yes | yes |
| 4196_AV38-1_with_BV10-3 | R175H | yes | yes |
| 4196_AV6_with_BV11-2 | R175H | yes | yes |
| 4253-TIL-TCR1 | R248W | yes | no |
| 4253-TIL-TCR2 | R248W | yes | no |
| 4266-TCR1 | R248W | yes | no |
| 4266-TCR2 | R248W | yes | yes |
| 4266-TCR3 | R248W | yes | yes |
| 4266-TCR4 | R248W | yes | yes |
| 4268-TCR1 | R248Q | yes | no |
| 4268-TCR2 | R248Q | yes | no |
| 4268-TCR3 | R248Q | yes | no |
| 4268-TCR4 | R248Q | yes | no |
| 4268-TCR5 | R248Q | yes | no |
| 4273-TP53-R248W-TCR1a1 | R248W | yes | no |
| 4273-TP53-R248W-TCR1a2 | R248W | yes | Yes |

TABLE 52-continued

| TCR name | p53 a.a. substitution | TCR tested? | p53 mutation reactive? |
|---|---|---|---|
| 4141-TCR1a2 | R175H | yes | yes |
| 4285-TCR1 | R175H | yes | yes |
| 4259-F6-TCR | Y220C | yes | yes |
| 4127-O37-TCR | G245S | yes | yes |

All references, including publications, patent applications, and patents, cited herein are hereby incorporated by reference to the same extent as if each reference were individually and specifically indicated to be incorporated by reference and were set forth in its entirety herein.

The use of the terms "a" and "an" and "the" and "at least one" and similar referents in the context of describing the invention (especially in the context of the following claims) are to be construed to cover both the singular and the plural, unless otherwise indicated herein or clearly contradicted by context. The use of the term "at least one" followed by a list of one or more items (for example, "at least one of A and B") is to be construed to mean one item selected from the listed items (A or B) or any combination of two or more of the listed items (A and B), unless otherwise indicated herein or clearly contradicted by context. The terms "comprising," "having," "including," and "containing" are to be construed as open-ended terms (i.e., meaning "including, but not limited to,") unless otherwise noted. Recitation of ranges of values herein are merely intended to serve as a shorthand method of referring individually to each separate value falling within the range, unless otherwise indicated herein, and each separate value is incorporated into the specification as if it were individually recited herein. All methods described herein can be performed in any suitable order unless otherwise indicated herein or otherwise clearly contradicted by context. The use of any and all examples, or exemplary language (e.g., "such as") provided herein, is intended merely to better illuminate the invention and does not pose a limitation on the scope of the invention unless otherwise claimed. No language in the specification should be construed as indicating any non-claimed element as essential to the practice of the invention.

Preferred embodiments of this invention are described herein, including the best mode known to the inventors for carrying out the invention. Variations of those preferred embodiments may become apparent to those of ordinary skill in the art upon reading the foregoing description. The inventors expect skilled artisans to employ such variations as appropriate, and the inventors intend for the invention to be practiced otherwise than as specifically described herein. Accordingly, this invention includes all modifications and equivalents of the subject matter recited in the claims appended hereto as permitted by applicable law. Moreover, any combination of the above-described elements in all possible variations thereof is encompassed by the invention unless otherwise indicated herein or otherwise clearly contradicted by context.

SEQUENCE LISTING (602 sequences)

SEQ ID NO: 1 - protein, 393 aa, Homo sapiens [sequence omitted]

SEQ ID NO: 2 - protein, 25 aa, Homo sapiens
YKQSQHMTEVVRHCPHHERCSDSDG

SEQ ID NO: 3 - protein, 25 aa, Homo sapiens
SGNLLGRNSFEVHVCACPGRDRRTE

SEQ ID NO: 4 - protein, 25 aa, Homo sapiens
YMCNSSCMGGMNLRPILTIITLEDS

SEQ ID NO: 5 - protein, 25 aa, Homo sapiens
FEVRVCACPGRDWRTEEENLRKKGE

SEQ ID NO: 6 - protein, 25 aa, Homo sapiens
SGNLLGRNSFEVCVCACPGRDRRTE

SEQ ID NO: 7 - protein, 25 aa, Homo sapiens
HYNYMCNSSCMGSMNRRPILTIITL

SEQ ID NO: 8 - protein, 25 aa, Homo sapiens
YMCNSSCMGGMNQRPILTIITLEDS

SEQ ID NO: 9 - protein, 25 aa, Homo sapiens
HYNYMCNSSCMGDMNRRPILTIITL

SEQ ID NO: 10 - protein, 25 aa, Homo sapiens
SGNLLGRNSFEVLVCACPGRDRRTE

SEQ ID NO: 11 - protein, 25 aa, Homo sapiens
YMCNSSCMGGMNWRPILTIITLEDS

SEQ ID NO: 12 - protein, 25 aa, Homo sapiens
DRNTFRHSVVVPCEPPEVGSDCTTI

SEQ ID NO: 13 - protein, 25 aa, Homo sapiens
MCNSSCMGGMNRSPILTIITLEDSS

SEQ ID NO: 14 - protein, 300 aa, Artificial Sequence
  Synthetic
YKQSQHMTEVVRHCPHHERCSDSDGSGNLLGRNSFEVHVCACPGRDRRTEYMCNSSCMGGMNLRPILTIITLEDSFEVRVCACPGRDWRTEEENLRKKGESGNLLGRNSFEVCVCACPGRDRRTEHYNYMCNSSCMGSMNRRPILTIITLYMCNSSCMGGMNQRPILTIITLEDSHYNYMCNSSCMGDMNRRPILTIITLSGNLLGRNSFEVLVCACPGRDRRTEYMCNSSCMGGMNWRPILTIITLEDSDRNTFRHSVVVPCEPPEVGSDCTTIMCNSSCMGGMNRSPILTIITLEDSS

SEQ ID NO: 15 - protein, 25 aa, Homo sapiens
YKQSQHMTEVVRRCPHHERCSDSDG

SEQ ID NO: 16 - protein, 25 aa, Homo sapiens
SGNLLGRNSFEVRVCACPGRDRRTE

SEQ ID NO: 17 - protein, 25 aa, Homo sapiens
YMCNSSCMGGMNRRPILTIITLEDS

SEQ ID NO: 18 - protein, 25 aa, Homo sapiens
FEVRVCACPGRDRRTEEENLRKKGE

SEQ ID NO: 19 - protein, 25 aa, Homo sapiens
HYNYMCNSSCMGGMNRRPILTIITL

SEQ ID NO: 20 - protein, 25 aa, Homo sapiens
DRNTFRHSVVVPYEPPEVGSDCTTI

SEQ ID NO: 21 - protein, 25 aa, Homo sapiens
MCNSSCMGGMNRRPILTIITLEDSS

SEQ ID NO: 22 - protein, 300 aa, Artificial Sequence
  Synthetic
YKQSQHMTEVVRRCPHHERCSDSDGSGNLLGRNSFEVRVCACPGRDRRTEYMCNSSCMGGMNRRPILTIITLEDSFEVRVCACPGRDRRTEEENLRKKGESGNLLGRNSFEVRVCACPGRDRRTEHYNYMCNSSCMGGMNRRPILTIITLYMCNSSCMGGMNRRPILTIITLEDSHYNYMCNSSCMGGMNRRPILTIITLSGNLLGRNSFEVRVCACPGRDRRTEYMCNSSCMGGMNRRPILTIITLEDSDRNTFRHSVVVPYEPPEVGSDCTTIMCNSSCMGGMNRRPILTIITLEDSS

SEQ ID NO: 23 - protein, 137 aa, Artificial Sequence
  Synthetic
NIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSS

SEQ ID NO: 24 - protein, 137 aa, Artificial Sequence
  Synthetic
DIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSS

SEQ ID NO: 25 - protein, 173 aa, Artificial Sequence
  Synthetic
EDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 26 - protein, 27 aa, Artificial Sequence
  Synthetic
RAKRSGSGATNFSLLKQAGDVEENPGP

SEQ ID NO: 27 - protein, 6 aa, Homo sapiens
YGGTVN

SEQ ID NO: 28 - protein, 8 aa, Homo sapiens
YFSGDPLV

SEQ ID NO: 29 - protein, 11 aa, Homo sapiens
CAVKGDYKLSF

SEQ ID NO: 30 - protein, 5 aa, Homo sapiens
SGHAT

SEQ ID NO: 31 - protein, 6 aa, Homo sapiens
FQNNGV

SEQ ID NO: 32 - protein, 12 aa, Homo sapiens
CASSLVNTEAFF

SEQ ID NO: 33 - protein, 130 aa, Homo sapiens
MLLLLIPVLGMIFALRDARAQSVSQHNHHVILSEAASLELGCNYSYGGTVNLFWYVQYPGQHLQLLLKYFSGDPLVKGIKGFEAEFIKSKFSFNLRKPSVQWSDTAEYFCAVKGDYKLSFGAGTTVTVRA

SEQ ID NO: 34 - protein, 131 aa, Homo sapiens
MATRLLCWAALCLLGAELTEAGVAQSPRYKIIEKRQSVAFWCNPISGHATLYWYQQILGQGPKLLIQFQNNGVVDDSQLPKDRFSAERLKGVDSTLKIQPAKLEDSAVYLCASSLVNTEAFFGQGTRLTVV

SEQ ID NO: 35 - protein, 267 aa, Homo sapiens
MLLLLIPVLGMIFALRDARAQSVSQHNHHVILSEAASLELGCNYSYGGTVNLFWYVQYPGQHLQLLLKYFSGDPLVKGIKGFEAEFIKSKFSFNLRKPSVQWSDTAEYFCAVKGDYKLSFGAGTTVTVRANIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSS

SEQ ID NO: 36 - protein, 304 aa, Homo sapiens
MATRLLCWAALCLLGAELTEAGVAQSPRYKIIEKRQSVAFWCNPISGHATLYWYQQILGQGPKLLIQFQNNGVVDDSQLPKDRFSAERLKGVDSTLKIQPAKLEDSAVYLCASSLVNTEAFFGQGTRLTVVEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 37 - protein, 7 aa, Homo sapiens
TRDTTYY

SEQ ID NO: 38 - protein, 8 aa, Homo sapiens
RNSFDEQN

SEQ ID NO: 39 - protein, 14 aa, Homo sapiens
CALSEGGSNYKLTF

SEQ ID NO: 40 - protein, 5 aa, Homo sapiens
LNHNV

SEQ ID NO: 41 - protein, 6 aa, Homo sapiens
YYDKDF

SEQ ID NO: 42 - protein, 14 aa, Homo sapiens
CATSRELRGNEQFF

SEQ ID NO: 43 - protein, 135 aa, Homo sapiens
MLTASLLRAVIASICVVSSMAQKVTQAQTEISVVEKEDVTLDCVYETRDTTYYLFWYKQPPSGELVFLIRRNSFDEQNEISGRYSWNFQKSTSSFNFTITASQVVDSAVYFCALSEGGSNYKLTFGKGTLLTVNP

SEQ ID NO: 44 - protein, 132 aa, Homo sapiens
MAPGLLHWMALCLLGTGHGDAMVIQNPRYQVTQFGKPVTLSCSQTLNHNVMYWYQQKSSQAPKLLFHYYDKDFNNEADTPDNFQSRRPNTSFCFLDIRSPGLGDAAMYLCATSRELRGNEQFFGPGTRLTVL

SEQ ID NO: 45 - protein, 272 aa, Homo sapiens
MLTASLLRAVIASICVVSSMAQKVTQAQTEISVVEKEDVTLDCVYETRDTTYYLFWYKQPPSGELVFLIRRNSFDEQNEISGRYSWNFQKSTSSFNFTITASQVVDSAVYFCALSEGGSNYKLTFGKGTLLTVNPNIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSS

SEQ ID NO: 46 - protein, 305 aa, Homo sapiens
MAPGLLHWMALCLLGTGHGDAMVIQNPRYQVTQFGKPVTLSCSQTLNHNVMYWYQQKSSQAPKLLFHYYDKDFNNEADTPDNFQSRRPNTSFCFLDIRSPGLGDAAMYLCATSRELRGNEQFFGPGTRLTVLEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 47 - protein, 6 aa, Homo sapiens
TSGFNG

SEQ ID NO: 48 - protein, 6 aa, Homo sapiens
NVLDGL

SEQ ID NO: 49 - protein, 13 aa, Homo sapiens
CAVKWTGGFKTIF

SEQ ID NO: 50 - protein, 5 aa, Homo sapiens
MNHEY

SEQ ID NO: 51 - protein, 6 aa, Homo sapiens
SVGAGI

SEQ ID NO: 52 - protein, 14 aa, Homo sapiens
CASSYRESHYGYTF

SEQ ID NO: 53 - protein, 127 aa, Homo sapiens
MWGVFLLYVSMKMGGTTGQNIDQPTEMTATEGAIVQINCTYQTSGFNGLFWYQQHAGEAPTFLSYNVLDGLEEKGRFSSFLSRSKGYSYLLLKELQMKDSASYLCAVKWTGGFKTIFGAGTRLFVKA

SEQ ID NO: 54 - protein, 134 aa, Homo sapiens
MAMSIGLLCCAALSLLWAGPVNAGVTQTPKFQVLKTGQSMTLQCAQDMNHEYMSWYRQDPGMGLRLIHYSVGAGITDQGEVPNGYNVSRSTTEDFPLRLLSAAPSQTSVYFCASSYRESHYGYTFGSGTRLTVV

SEQ ID NO: 55 - protein, 264 aa, Homo sapiens
MWGVFLLYVSMKMGGTTGQNIDQPTEMTATEGAIVQINCTYQTSGFNGLFWYQQHAGEAPTFLSYNVLDGLEEKGRFSSFLSRSKGYSYLLLKELQMKDSASYLCAVKWTGGFKTIFGAGTRLFVKANIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSS

SEQ ID NO: 56 - protein, 307 aa, Homo sapiens
MAMSIGLLCCAALSLLWAGPVNAGVTQTPKFQVLKTGQSMTLQCAQDMNHEYMSWYRQDPGMGLRLIHYSVGAGITDQGEVPNGYNVSRSTTEDFPLRLLSAAPSQTSVYFCASSYRESHYGYTFGSGTRLTVVEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 57 - protein, 6 aa, Homo sapiens
VSGNPY

SEQ ID NO: 58 - protein, 8 aa, Homo sapiens
YITGDNLV

SEQ ID NO: 59 - protein, 12 aa, Homo sapiens
CAVRVWDYKLSF

SEQ ID NO: 60 - protein, 5 aa, Homo sapiens
LNHDA

SEQ ID NO: 61 - protein, 6 aa, Homo sapiens
SQIVND

SEQ ID NO: 62 - protein, 14 aa, Homo sapiens
CASSISAGGDGYTF

SEQ ID NO: 63 - protein, 131 aa, Homo sapiens
MASAPISMLAMLFTLSGLRAQSVAQPEDQVNVAEGNPLTVKCTYSVSGNPYLFWYVQYPNRGLQFLLKYITGDNLVKGSYGFEAEFNKSQTSFHLKKPSALVSDSALYFCAVRVWDYKLSFGAGTTVTVRA

SEQ ID NO: 64 - protein, 132 aa, Homo sapiens
MHNQVLCCVVLCFLGANTVDGGITQSPKYLFRKEGQNVTLSCEQNLNHDAMYWYRQDPGQGLRLIYYSQIVNDFQKGDIAEGYSVSREKKESFPLTVTSAQKNPTAFYLCASSISAGGDGYTFGSGTRLTVV

SEQ ID NO: 65 - protein, 268 aa, Homo sapiens
MASAPISMLAMLFTLSGLRAQSVAQPEDQVNVAEGNPLTVKCTYSVSGNPYLFWYVQYPNRGLQFLLKYITGDNLVKGSYGFEAEFNKSQTSFHLKKPSALVSDSALYFCAVRVWDYKLSFGAGTTVTVRANIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSS

SEQ ID NO: 66 - protein, 305 aa, Homo sapiens
MHNQVLCCVVLCFLGANTVDGGITQSPKYLFRKEGQNVTLSCEQNLNHDAMYWYRQDPGQGLRLIYYSQIVNDFQKGDIAEGYSVSREKKESFPLTVTSAQKNPTAFYLCASSISAGGDGYTFGSGTRLTVVEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 67 - protein, 6 aa, Homo sapiens
NSASQS

SEQ ID NO: 68 - protein, 6 aa, Homo sapiens
VYSSGN

SEQ ID NO: 69 - protein, 13 aa, Homo sapiens
CVVQPGGYQKVTF

SEQ ID NO: 70 - protein, 5 aa, Homo sapiens
MNHNS

SEQ ID NO: 71 - protein, 6 aa, Homo sapiens
SASEGT

SEQ ID NO: 72 - protein, 16 aa, Homo sapiens
CASSEGLWQVGDEQYF

SEQ ID NO: 73 - protein, 131 aa, Homo sapiens
MISLRVLLVILWLQLSWVWSQRKEVEQDPGPFNVPEGATVAFNCTYSNSASQSFFWYRQDCRKEPKLLMSVYSSGNEDGRFTAQLNRASQYISLLIRDSKLSDSATYLCVVQPGGYQKVTFGTGTKLQVIP

SEQ ID NO: 74 - protein, 134 aa, Homo sapiens
MAIGLLCCVAFSLLWASPVNAGVTQTPKFQVLKTGQSMTLQCAQDMNHNSMYWYRQDPGMGLRLIYYSASEGTTDKGEVPNGYNVSRLNKREFSLRLESAAPSQTSVYFCASSEGLWQVGDEQYFGPGTRLTVT

SEQ ID NO: 75 - protein, 268 aa, Homo sapiens
MISLRVLLVILWLQLSWVWSQRKEVEQDPGPFNVPEGATVAFNCTYSNSASQSFFWYRQDCRKEPKLLMSVYSSGNEDGRFTAQLNRASQYISLLIRDSKLSDSATYLCVVQPGGYQKVTFGTGTKLQVIPDIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSS

SEQ ID NO: 76 - protein, 307 aa, Homo sapiens
MAIGLLCCVAFSLLWASPVNAGVTQTPKFQVLKTGQSMTLQCAQDMNHNSMYWYRQDPGMGLRLIYYSASEGTTDKGEVPNGYNVSRLNKREFSLRLESAAPSQTSVYFCASSEGLWQVGDEQYFGPGTRLTVTEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 77 - protein, 7 aa, Homo sapiens
TSENNYY

SEQ ID NO: 78 - protein, 8 aa, Homo sapiens
QEAYKQQN

SEQ ID NO: 79 - protein, 16 aa, Homo sapiens
CAFMGYSGAGSYQLTF

SEQ ID NO: 80 - protein, 5 aa, Homo sapiens
ENHRY

SEQ ID NO: 81 - protein, 6 aa, Homo sapiens
SYGVKD

SEQ ID NO: 82 - protein, 15 aa, Homo sapiens
CAISELVTGDSPLHF

SEQ ID NO: 83 - protein, 137 aa, Homo sapiens
MTRVSLLWAVVVSTCLESGMAQTVTQSQPEMSVQEAETVTLSCTYDTSENNYYLFWYKQPPSRQMILVIRQEAYKQQNATENRFSVNFQKAAKSFSLKISDSQLGDTAMYFCAFMGYSGAGSYQLTFGKGTKLSVIP

SEQ ID NO: 84 - protein, 133 aa, Homo sapiens
MATRLFFYVALCLLWTGHMDAGITQSPRHKVTETGTPVTLRCHQTENHRYMYWYRQDPGHGLRLIHYSYGVKDTDKGEVSDGYSVSRSKTEDFLLTLESATSSQTSVYFCAISELVTGDSPLHFGNGTRLTVT

SEQ ID NO: 85 - protein, 274 aa, Homo sapiens
MTRVSLLWAVVVSTCLESGMAQTVTQSQPEMSVQEAETVTLSCTYDTSENNYYLFWYKQPPSRQMILVIRQEAYKQQNATENRFSVNFQKAAKSFSLKISDSQLGDTAMYFCAFMGYSGAGSYQLTFGKGTKLSVIPDIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSS

SEQ ID NO: 86 - protein, 306 aa, Homo sapiens
MATRLFFYVALCLLWTGHMDAGITQSPRHKVTETGTPVTLRCHQTENHRYMYWYRQDPGHGLRLIHYSYGVKDTDKGEVSDGYSVSRSKTEDFLLTLESATSSQTSVYFCAISELVTGDSPLHFGNGTRLTVTEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 87 - protein, 6 aa, Homo sapiens
NYSPAY

SEQ ID NO: 88 - protein, 7 aa, Homo sapiens
IRENEKE

SEQ ID NO: 89 - protein, 12 aa, Homo sapiens
CALDIYPHDMRF

SEQ ID NO: 90 - protein, 5 aa, Homo sapiens
SGHAT

SEQ ID NO: 91 - protein, 6 aa, Homo sapiens
FQNNGV

SEQ ID NO: 92 - protein, 15 aa, Homo sapiens
CASSLDPGDTGELFF

SEQ ID NO: 93 - protein, 131 aa, Homo sapiens
MESFLGGVLLILWLQVDWVKSQKIEQNSEALNIQEGKTATLTCNYTNYSPAYLQWYRQDPGRGPVFLLLIRENEKEKRKERLKVTFDTTLKQSLFHITASQPADSATYLCALDIYPHDMRFGAGTRLTVKP

SEQ ID NO: 94 - protein, 134 aa, Homo sapiens
MATRLLCWAALCLLGAELTEAGVAQSPRYKIIEKRQSVAFWCNPISGHATLYWYQQILGQGPKLLIQFQNNGVVDDSQLPKDRFSAERLKGVDSTLKIQPAKLEDSAVYLCASSLDPGDTGELFFGEGSRLTVL

SEQ ID NO: 95 - protein, 268 aa, Homo sapiens
MESFLGGVLLILWLQVDWVKSQKIEQNSEALNIQEGKTATLTCNYTNYSPAYLQWYRQDPGRGPVFLLLIRENEKEKRKERLKVTFDTTLKQSLFHITASQPADSATYLCALDIYPHDMRFGAGTRLTVKPDIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSS

SEQ ID NO: 96 - protein, 307 aa, Homo sapiens
MATRLLCWAALCLLGAELTEAGVAQSPRYKIIEKRQSVAFWCNPISGHATLYWYQQILGQGPKLLIQFQNNGVVDDSQLPKDRFSAERLKGVDSTLKIQPAKLEDSAVYLCASSLDPGDTGELFFGEGSRLTVLEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 97 - protein, 6 aa, Homo sapiens
SSVSVY

SEQ ID NO: 98 - protein, 8 aa, Homo sapiens
YLSGSTLV

SEQ ID NO: 99 - protein, 14 aa, Homo sapiens
CAVSDLVRDDKIIF

SEQ ID NO: 100 - protein, 5 aa, Homo sapiens
MNHNS

SEQ ID NO: 101 - protein, 6 aa, Homo sapiens
SASEGT

SEQ ID NO: 102 - protein, 11 aa, Homo sapiens
CASIGGFEAFF

SEQ ID NO: 103 - protein, 133 aa, Homo sapiens
MALLLVPAFQVIFTLGGTRAQSVTQLDSQVPVFEEAPVELRCNYSSSVSVYLFWYVQYPNQGLQLLLKYLSGSTLVESINGFEAEFNKSQTSFHLRKPSVHISDTAEYFCAVSDLVRDDKIIFGKGTRLHILP

SEQ ID NO: 104 - protein, 129 aa, Homo sapiens
MHIGLLCCVAFSLLWASPVNAGVTQTPKFQVLKTGQSMTLQCAQDMNHNSMYWYRQDPGMGLRLIYYSASEGTTDKGEVPNGYNVSRLNKREFSLRLESAAPSQTSVYFCASIGGFEAFFGQGTRLTVV

SEQ ID NO: 105 - protein, 270 aa, Homo sapiens
MALLLVPAFQVIFTLGGTRAQSVTQLDSQVPVFEEAPVELRCNYSSSVSVYLFWYVQYPNQGLQLLLKYLSGSTLVESINGFEAEFNKSQTSFHLRKPSVHISDTAEYFCAVSDLVRDDKIIFGKGTRLHILPNIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSS

SEQ ID NO: 106 - protein, 302 aa, Homo sapiens
MHIGLLCCVAFSLLWASPVNAGVTQTPKFQVLKTGQSMTLQCAQDMNHNSMYWYRQDPGMGLRLIYYSASEGTTDKGEVPNGYNVSRLNKREFSLRLESAAPSQTSVYFCASIGGFEAFFGQGTRLTVVEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 107 - protein, 6 aa, Homo sapiens
TSGFNG

SEQ ID NO: 108 - protein, 6 aa, Homo sapiens
NVLDGL

SEQ ID NO: 109 - protein, 12 aa, Homo sapiens
CAVYTGGFKTIF

SEQ ID NO: 110 - protein, 5 aa, Homo sapiens
SGHAT

SEQ ID NO: 111 - protein, 6 aa, Homo sapiens
FQNNGV

SEQ ID NO: 112 - protein, 15 aa, Homo sapiens
CASNLGGGSTDTQYF

SEQ ID NO: 113 - protein, 126 aa, Homo sapiens
MAGVFLLYVSMKMGGTTGQNIDQPTEMTATEGAIVQINCTYQTSGFNGLFWYQQHAGEAPTFLSYNVLDGLEEKGRFSSFLSRSKGYSYLLLKELQMKDSASYLCAVYTGGFKTIFGAGTRLFVKA

SEQ ID NO: 114 - protein, 134 aa, Homo sapiens
MHTRLLCWAALCLLGAELTEAGVAQSPRYKIIEKRQSVAFWCNPISGHATLYWYQQILGQGPKLLIQFQNNGVVDDSQLPKDRFSAERLKGVDSTLKIQPAKLEDSAVYLCASNLGGGSTDTQYFGPGTRLTVL

SEQ ID NO: 115 - protein, 263 aa, Homo sapiens
MAGVFLLYVSMKMGGTTGQNIDQPTEMTATEGAIVQINCTYQTSGFNGLFWYQQHAGEAPTFLSYNVLDGLEEKGRFSSFLSRSKGYSYLLLKELQMKDSASYLCAVYTGGFKTIFGAGTRLFVKANIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSS

SEQ ID NO: 116 - protein, 307 aa, Homo sapiens
MHTRLLCWAALCLLGAELTEAGVAQSPRYKIIEKRQSVAFWCNPISGHATLYWYQQILGQGPKLLIQFQNNGVVDDSQLPKDRFSAERLKGVDSTLKIQPAKLEDSAVYLCASNLGGGSTDTQYFGPGTRLTVLEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 117 - protein, 6 aa, Homo sapiens
TSGFNG

SEQ ID NO: 118 - protein, 6 aa, Homo sapiens
NVLDGL

SEQ ID NO: 119 - protein, 14 aa, Homo sapiens
CAFYYGGSQGNLIF

SEQ ID NO: 120 - protein, 5 aa, Homo sapiens
SGHVS

SEQ ID NO: 121 - protein, 6 aa, Homo sapiens
FQNEAQ

SEQ ID NO: 122 - protein, 15 aa, Homo sapiens
CASSFGSGSTDTQYF

SEQ ID NO: 123 - protein, 128 aa, Homo sapiens
MAGVFLLYVSMKMGGTTGQNIDQPTEMTATEGAIVQINCTYQTSGFNGLFWYQQHAGEAPTFLSYNVLDGLEEKGRFSSFLSRSKGYSYLLLKELQMKDSASYLCAFYYGGSQGNLIFGKGTKLSVKP

SEQ ID NO: 124 - protein, 134 aa, Homo sapiens
MHTRLLCWVVLGFLGTDHTGAGVSQSPRYKVAKRGQDVALRCDPISGHVSLFWYQQALGQGPEFLTYFQNEAQLDKSGLPSDRFFAERPEGSVSTLKIQRTQQEDSAVYLCASSFGSGSTDTQYFGPGTRLTVL

SEQ ID NO: 125 - protein, 265 aa, Homo sapiens
MAGVFLLYVSMKMGGTTGQNIDQPTEMTATEGAIVQINCTYQTSGFNGLFWYQQHAGEAPTFLSYNVLDGLEEKGRFSSFLSRSKGYSYLLLKELQMKDSASYLCAFYYGGSQGNLIFGKGTKLSVKPNIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSS

SEQ ID NO: 126 - protein, 307 aa, Homo sapiens
MHTRLLCWVVLGFLGTDHTGAGVSQSPRYKVAKRGQDVALRCDPISGHVSLFWYQQALGQGPEFLTYFQNEAQLDKSGLPSDRFFAERPEGSVSTLKIQRTQQEDSAVYLCASSFGSGSTDTQYFGPGTRLTVLEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 127 - protein, 6 aa, Homo sapiens
TSGFNG

SEQ ID NO: 128 - protein, 6 aa, Homo sapiens
NVLDGL

SEQ ID NO: 129 - protein, 14 aa, Homo sapiens
CAVYPGGSQGNLIF

SEQ ID NO: 130 - protein, 5 aa, Homo sapiens
SGHAT

SEQ ID NO: 131 - protein, 6 aa, Homo sapiens
FQNNGV

SEQ ID NO: 132 - protein, 15 aa, Homo sapiens
CASSLGTGSTDTQYF

SEQ ID NO: 133 - protein, 128 aa, Homo sapiens
MAGVFLLYVSMKMGGTTGQNIDQPTEMTATEGAIVQINCTYQTSGFNGLFWYQQHAGEAPTFLSYNVLDGLEEKGRFSSFLSRSKGYSYLLLKELQMKDSASYLCAVYPGGSQGNLIFGKGTKLSVKP

SEQ ID NO: 134 - protein, 134 aa, Homo sapiens
MHTRLLCWAALCLLGAELTEAGVAQSPRYKIIEKRQSVAFWCNPISGHATLYWYQQILGQGPKLLIQFQNNGVVDDSQLPKDRFSAERLKGVDSTLKIQPAKLEDSAVYLCASSLGTGSTDTQYFGPGTRLTVL

SEQ ID NO: 135 - protein, 265 aa, Homo sapiens
MAGVFLLYVSMKMGGTTGQNIDQPTEMTATEGAIVQINCTYQTSGFNGLFWYQQHAGEAPTFLSYNVLDGLEEKGRFSSFLSRSKGYSYLLLKELQMKDSASYLCAVYPGGSQGNLIFGKGTKLSVKPNIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSS

SEQ ID NO: 136 - protein, 307 aa, Homo sapiens
MHTRLLCWAALCLLGAELTEAGVAQSPRYKIIEKRQSVAFWCNPISGHATLYWYQQILGQGPKLLIQFQNNGVVDDSQLPKDRFSAERLKGVDSTLKIQPAKLEDSAVYLCASSLGTGSTDTQYFGPGTRLTVLEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 137 - protein, 6 aa, Homo sapiens
DRGSQS

SEQ ID NO: 138 - protein, 6 aa, Homo sapiens
IYSNGD

SEQ ID NO: 139 - protein, 11 aa, Homo sapiens
CAVSWYSTLTF

SEQ ID NO: 140 - protein, 5 aa, Homo sapiens
WSHSY

SEQ ID NO: 141 - protein, 6 aa, Homo sapiens
SAAADI

SEQ ID NO: 142 - protein, 13 aa, Homo sapiens
CASSGSRTDTQYF

SEQ ID NO: 143 - protein, 130 aa, Homo sapiens
MASLRVLLVILWLQLSWVWSQQKEVEQNSGPLSVPEGAIASLNCTYSDRGSQSFFWYRQYSGKSPELIMFIYSNGDKEDGRFTAQLNKASQYVSLLIRDSQPSDSATYLCAVSWYSTLTFGKGTMLLVSP

SEQ ID NO: 144 - protein, 131 aa, Homo sapiens
MHTRLFFYVALCLLWAGHRDAGITQSPRYKITETGRQVTLMCHQTWSHSYMFWYRQDLGHGLRLIYYSAAADITDKGEVPDGYVVSRSKTENFPLTLESATRSQTSVYFCASSGSRTDTQYFGPGTRLTVL

SEQ ID NO: 145 - protein, 267 aa, Homo sapiens
MASLRVLLVILWLQLSWVWSQQKEVEQNSGPLSVPEGAIASLNCTYSDRGSQSFFWYRQYSGKSPELIMFIYSNGDKEDGRFTAQLNKASQYVSLLIRDSQPSDSATYLCAVSWYSTLTFGKGTMLLVSPNIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSS

SEQ ID NO: 146 - protein, 304 aa, Homo sapiens
MHTRLFFYVALCLLWAGHRDAGITQSPRYKITETGRQVTLMCHQTWSHSYMFWYRQDLGHGLRLIYYSAAADITDKGEVPDGYVVSRSKTENFPLTLESATRSQTSVYFCASSGSRTDTQYFGPGTRLTVLEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 147 - protein, 5 aa, Homo sapiens
SVFSS

SEQ ID NO: 148 - protein, 7 aa, Homo sapiens
VVTGGEV

SEQ ID NO: 149 - protein, 12 aa, Homo sapiens
CAGEFAGNQFYF

SEQ ID NO: 150 - protein, 5 aa, Homo sapiens
MGHRA

SEQ ID NO: 151 - protein, 6 aa, Homo sapiens
YSYEKL

SEQ ID NO: 152 - protein, 14 aa, Homo sapiens
CASSQVGLTYEQYF

SEQ ID NO: 153 - protein, 128 aa, Homo sapiens
MALKFSVSILWIQLAWVSTQLLEQSPQFLSIQEGENLTVYCNSSSVFSSLQWYRQEPGEGPVLLVTVVTGGEVKKLKRLTFQFGDARKDSSLHITAAQPGDTGLYLCAGEFAGNQFYFGTGTSLTVIP

SEQ ID NO: 154 - protein, 132 aa, Homo sapiens
MHCRLLCCAVLCLLGAVPIDTEVTQTPKHLVMGMTNKKSLKCEQHMGHRAMYWYKQKAKKPPELMFVYSYEKLSINESVPSRFSPECPNSSLLNLHLHALQPEDSALYLCASSQVGLTYEQYFGPGTRLTVT

SEQ ID NO: 155 - protein, 265 aa, Homo sapiens
MALKFSVSILWIQLAWVSTQLLEQSPQFLSIQEGENLTVYCNSSSVFSSLQWYRQEPGEGPVLLVTVVTGGEVKKLKRLTFQFGDARKDSSLHITAAQPGDTGLYLCAGEFAGNQFYFGTGTSLTVIPNIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSS

SEQ ID NO: 156 - protein, 305 aa, Homo sapiens
MHCRLLCCAVLCLLGAVPIDTEVTQTPKHLVMGMTNKKSLKCEQHMGHRAMYWYKQKAKKPPELMFVYSYEKLSINESVPSRFSPECPNSSLLNLHLHALQPEDSALYLCASSQVGLTYEQYFGPGTRLTVTEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 157 - protein, 6 aa, Homo sapiens
VSGNPY

SEQ ID NO: 158 - protein, 8 aa, Homo sapiens
YITGDNLV

SEQ ID NO: 159 - protein, 16 aa, Homo sapiens
CAVRDNSGGSNYKLTF

SEQ ID NO: 160 - protein, 5 aa, Homo sapiens
SGHAT

SEQ ID NO: 161 - protein, 6 aa, Homo sapiens
FQNNGV

SEQ ID NO: 162 - protein, 13 aa, Homo sapiens
CASSLGQGQTQYF

SEQ ID NO: 163 - protein, 135 aa, Homo sapiens
MASAPISMLAMLFTLSGLRAQSVAQPEDQVNVAEGNPLTVKCTYSVSGNPYLFWYVQYPNRGLQFLLKYITGDNLVKGSYGFEAEFNKSQTSFHLKKPSALVSDSALYFCAVRDNSGGSNYKLTFGKGTLLTVNP

SEQ ID NO: 164 - protein, 132 aa, Homo sapiens
MHTRLLCWAALCLLGAELTEAGVAQSPRYKIIEKRQSVAFWCNPISGHATLYWYQQILGQGPKLLIQFQNNGVVDDSQLPKDRFSAERLKGVDSTLKIQPAKLEDSAVYLCASSLGQGQTQYFGPGTRLLVL

SEQ ID NO: 165 - protein, 272 aa, Homo sapiens
MASAPISMLAMLFTLSGLRAQSVAQPEDQVNVAEGNPLTVKCTYSVSGNPYLFWYVQYPNRGLQFLLKYITGDNLVKGSYGFEAEFNKSQTSFHLKKPSALVSDSALYFCAVRDNSGGSNYKLTFGKGTLLTVNPNIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSS

SEQ ID NO: 166 - protein, 305 aa, Homo sapiens
MHTRLLCWAALCLLGAELTEAGVAQSPRYKIIEKRQSVAFWCNPISGHATLYWYQQILGQGPKLLIQFQNNGVVDDSQLPKDRFSAERLKGVDSTLKIQPAKLEDSAVYLCASSLGQGQTQYFGPGTRLLVLEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 167 - protein, 6 aa, Homo sapiens
SSVSVY

SEQ ID NO: 168 - protein, 8 aa, Homo sapiens
YLSGSTLV

SEQ ID NO: 169 - protein, 14 aa, Homo sapiens
CAVRGSSGTYKYIF

SEQ ID NO: 170 - protein, 5 aa, Homo sapiens
MDHEN

SEQ ID NO: 171 - protein, 6 aa, Homo sapiens
SYDVKM

SEQ ID NO: 172 - protein, 13 aa, Homo sapiens
CASKGDQNTEAFF

SEQ ID NO: 173 - protein, 133 aa, Homo sapiens
MALLLVPAFQVIFTLGGTRAQSVTQLDSQVPVFEEAPVELRCNYSSSVSVYLFWYVQYPNQGLQLLLKYLSGSTLVESINGFEAEFNKSQTSFHLRKPSVHISDTAEYFCAVRGSSGTYKYIFGTGTRLKVLA

SEQ ID NO: 174 - protein, 131 aa, Homo sapiens
MHIRLLCRVAFCFLAVGLVDVKVTQSSRYLVKRTGEKVFLECVQDMDHENMFWYRQDPGLGLRLIYFSYDVKMKEKGDIPEGYSVSREKKERFSLILESASTNQTSMYLCASKGDQNTEAFFGQGTRLTVV

SEQ ID NO: 175 - protein, 270 aa, Homo sapiens
MALLLVPAFQVIFTLGGTRAQSVTQLDSQVPVFEEAPVELRCNYSSSVSVYLFWYVQYPNQGLQLLLKYLSGSTLVESINGFEAEFNKSQTSFHLRKPSVHISDTAEYFCAVRGSSGTYKYIFGTGTRLKVLANIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSS

SEQ ID NO: 176 - protein, 304 aa, Homo sapiens
MHIRLLCRVAFCFLAVGLVDVKVTQSSRYLVKRTGEKVFLECVQDMDHENMFWYRQDPGLGLRLIYFSYDVKMKEKGDIPEGYSVSREKKERFSLILESASTNQTSMYLCASKGDQNTEAFFGQGTRLTVVEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 177 - protein, 6 aa, Homo sapiens
TSGFNG

SEQ ID NO: 178 - protein, 6 aa, Homo sapiens
NVLDGL

SEQ ID NO: 179 - protein, 15 aa, Homo sapiens
CAVRDLQTGANNLFF

SEQ ID NO: 180 - protein, 5 aa, Homo sapiens
MDHEN

SEQ ID NO: 181 - protein, 6 aa, Homo sapiens
SYDVKM

SEQ ID NO: 182 - protein, 14 aa, Homo sapiens
CASSLTFGTTEAFF

SEQ ID NO: 183 - protein, 129 aa, Homo sapiens
MAGVFLLYVSMKMGGTTGQNIDQPTEMTATEGAIVQINCTYQTSGFNGLFWYQQHAGEAPTFLSYNVLDGLEEKGRFSSFLSRSKGYSYLLLKELQMKDSASYLCAVRDLQTGANNLFFGTGTRLTVIP

SEQ ID NO: 184 - protein, 132 aa, Homo sapiens
MHIRLLCRVAFCFLAVGLVDVKVTQSSRYLVKRTGEKVFLECVQDMDHENMFWYRQDPGLGLRLIYFSYDVKMKEKGDIPEGYSVSREKKERFSLILESASTNQTSMYLCASSLTFGTTEAFFGQGTRLTVV

SEQ ID NO: 185 - protein, 266 aa, Homo sapiens
MAGVFLLYVSMKMGGTTGQNIDQPTEMTATEGAIVQINCTYQTSGFNGLFWYQQHAGEAPTFLSYNVLDGLEEKGRFSSFLSRSKGYSYLLLKELQMKDSASYLCAVRDLQTGANNLFFGTGTRLTVIPNIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSS

SEQ ID NO: 186 - protein, 305 aa, Homo sapiens
MHIRLLCRVAFCFLAVGLVDVKVTQSSRYLVKRTGEKVFLECVQDMDHENMFWYRQDPGLGLRLIYFSYDVKMKEKGDIPEGYSVSREKKERFSLILESASTNQTSMYLCASSLTFGTTEAFFGQGTRLTVVEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 187 - protein, 6 aa, Homo sapiens
VTNFRS

SEQ ID NO: 188 - protein, 7 aa, Homo sapiens
LTSSGIE

SEQ ID NO: 189 - protein, 15 aa, Homo sapiens
CAGQNYGGSQGNLIF

SEQ ID NO: 190 - protein, 5 aa, Homo sapiens
SNHLY

SEQ ID NO: 191 - protein, 6 aa, Homo sapiens
FYNNEI

SEQ ID NO: 192 - protein, 12 aa, Homo sapiens
CASRDPAYEQYF

SEQ ID NO: 193 - protein, 134 aa, Homo sapiens
MAKCPQALLAIFWLLLSWVSSEDKVVQSPLSLVVHEGDTVTLNCSYEVTNFRSLLWYKQEKKAPTFLFMLTSSGIEKKSGRLSSILDKKELSSILNITATQTGDSAIYLCAGQNYGGSQGNLIFGKGTKLSVKP

SEQ ID NO: 194 - protein, 131 aa, Homo sapiens
MHTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCASRDPAYEQYFGPGTRLTVT

SEQ ID NO: 195 - protein, 271 aa, Homo sapiens
MAKCPQALLAIFWLLLSWVSSEDKVVQSPLSLVVHEGDTVTLNCSYEVTNFRSLLWYKQEKKAPTFLFMLTSSGIEKKSGRLSSILDKKELSSILNITATQTGDSAIYLCAGQNYGGSQGNLIFGKGTKLSVKPNIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSS

SEQ ID NO: 196 - protein, 304 aa, Homo sapiens
MHTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCASRDPAYEQYFGPGTRLTVTEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 197 - protein, 6 aa, Homo sapiens
DRGSQS

SEQ ID NO: 198 - protein, 6 aa, Homo sapiens
IYSNGD

SEQ ID NO: 199 - protein, 16 aa, Homo sapiens
CAVNPPVKTSYDKVIF

SEQ ID NO: 200 - protein, 5 aa, Homo sapiens
SGHVS

SEQ ID NO: 201 - protein, 6 aa, Homo sapiens
FNYEAQ

SEQ ID NO: 202 - protein, 15 aa, Homo sapiens
CASSHREPHTGELFF

SEQ ID NO: 203 - protein, 135 aa, Homo sapiens
MASLRVLLVILWLQLSWVWSQQKEVEQNSGPLSVPEGAIASLNCTYSDRGSQSFFWYRQYSGKSPELIMFIYSNGDKEDGRFTAQLNKASQYVSLLIRDSQPSDSATYLCAVNPPVKTSYDKVIFGPGTSLSVIP

SEQ ID NO: 204 - protein, 134 aa, Homo sapiens
MHTSLLCWVVLGFLGTDHTGAGVSQSPRYKVTKRGQDVALRCDPISGHVSLYWYRQALGQGPEFLTYFNYEAQQDKSGLPNDRFSAERPEGSISTLTIQRTEQRDSAMYRCASSHREPHTGELFFGEGSRLTVL

SEQ ID NO: 205 - protein, 272 aa, Homo sapiens
MASLRVLLVILWLQLSWVWSQQKEVEQNSGPLSVPEGAIASLNCTYSDRGSQSFFWYRQYSGKSPELIMFIYSNGDKEDGRFTAQLNKASQYVSLLIRDSQPSDSATYLCAVNPPVKTSYDKVIFGPGTSLSVIPNIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSS

SEQ ID NO: 206 - protein, 307 aa, Homo sapiens
MHTSLLCWVVLGFLGTDHTGAGVSQSPRYKVTKRGQDVALRCDPISGHVSLYWYRQALGQGPEFLTYFNYEAQQDKSGLPNDRFSAERPEGSISTLTIQRTEQRDSAMYRCASSHREPHTGELFFGEGSRLTVLEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 207 - protein, 7 aa, Homo sapiens
TRDTTYY

SEQ ID NO: 208 - protein, 8 aa, Homo sapiens
RNSFDEQN

SEQ ID NO: 209 - protein, 15 aa, Homo sapiens
CALSEVDSGNTPLVF

SEQ ID NO: 210 - protein, 5 aa, Homo sapiens
SGDLS

SEQ ID NO: 211 - protein, 6 aa, Homo sapiens
YYNGEE

SEQ ID NO: 212 - protein, 16 aa, Homo sapiens
CASSVGSSSSTDTQYF

SEQ ID NO: 213 - protein, 136 aa, Homo sapiens
MATASLLRAVIASICVVSSMAQKVTQAQTEISVVEKEDVTLDCVYETRDTTYYLFWYKQPPSGELVFLIRRNSFDEQNEISGRYSWNFQKSTSSFNFTITASQVVDSAVYFCALSEVDSGNTPLVFGKGTRLSVIA

SEQ ID NO: 214 - protein, 134 aa, Homo sapiens
MHFRLLCCVAFCLLGAGPVDSGVTQTPKHLITATGQRVTLRCSPRSGDLSVYWYQQSLDQGLQFLIQYYNGEERAKGNILERFSAQQFPDLHSELNLSSLELGDSALYFCASSVGSSSSTDTQYFGPGTRLTVL

SEQ ID NO: 215 - protein, 273 aa, Homo sapiens
MATASLLRAVIASICVVSSMAQKVTQAQTEISVVEKEDVTLDCVYETRDTTYYLFWYKQPPSGELVFLIRRNSFDEQNEISGRYSWNFQKSTSSFNFTITASQVVDSAVYFCALSEVDSGNTPLVFGKGTRLSVIANIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSS

SEQ ID NO: 216 - protein, 307 aa, Homo sapiens
MHFRLLCCVAFCLLGAGPVDSGVTQTPKHLITATGQRVTLRCSPRSGDLSVYWYQQSLDQGLQFLIQYYNGEERAKGNILERFSAQQFPDLHSELNLSSLELGDSALYFCASSVGSSSSTDTQYFGPGTRLTVLEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 217 - protein, 7 aa, Homo sapiens
TRDTTYY

SEQ ID NO: 218 - protein, 8 aa, Homo sapiens
RNSFDEQN

SEQ ID NO: 219 - protein, 15 aa, Homo sapiens
CALSEVDSGNTPLVF

SEQ ID NO: 220 - protein, 5 aa, Homo sapiens
SGDLS

SEQ ID NO: 221 - protein, 6 aa, Homo sapiens
YYNGEE

SEQ ID NO: 222 - protein, 16 aa, Homo sapiens
CASSVGSSSSTDTQYF

SEQ ID NO: 223 - protein, 136 aa, Homo sapiens; identical to SEQ ID NO: 213

SEQ ID NO: 224 - protein, 134 aa, Homo sapiens
MHFRLLCCVAFCLLGAGPVDSGVTQTPKHLITATGQRVTLRCSPRSGDLSVYWYQQSLDQGLQFLIHYYNGEERAKGNILERFSAQQFPDLHSELNLSSLELGDSALYFCASSVGSSSSTDTQYFGPGTRLTVL

SEQ ID NO: 225 - protein, 273 aa, Homo sapiens; identical to SEQ ID NO: 215

SEQ ID NO: 226 - protein, 307 aa, Homo sapiens
MHFRLLCCVAFCLLGAGPVDSGVTQTPKHLITATGQRVTLRCSPRSGDLSVYWYQQSLDQGLQFLIHYYNGEERAKGNILERFSAQQFPDLHSELNLSSLELGDSALYFCASSVGSSSSTDTQYFGPGTRLTVLEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 227 - protein, 6 aa, Homo sapiens
NSAFQY

SEQ ID NO: 228 - protein, 6 aa, Homo sapiens
TYSSGN

SEQ ID NO: 229 - protein, 14 aa, Homo sapiens
CAMTSPYNNNDMRF

SEQ ID NO: 230 - protein, 6 aa, Homo sapiens
DFQATT

SEQ ID NO: 231 - protein, 7 aa, Homo sapiens
SNEGSKA

SEQ ID NO: 232 - protein, 13 aa, Homo sapiens
CSGGLEEAARQFI

SEQ ID NO: 233 - protein, 134 aa, Homo sapiens
MAKSLRVLLVILWLQLSWVWSQQKEVEQDPGPLSVPEGAIVSLNCTYSNSAFQYFMWYRQYSRKGPELLMYTYSSGNKEDGRFTAQVDKSSKYISLFIRDSQPSDSATYLCAMTSPYNNNDMRFGAGTRLTVKP

SEQ ID NO: 234 - protein, 140 aa, Homo sapiens
MHLLLLLLGPGISLLLPGSLAGSGLGAVVSQHPSWVICKSGTSVKIECRSLDFQATTMFWYRQFPKQSLMLMATSNEGSKATYEQGVEKDKFLINHASLTLSTLTVTSAHPEDSSFYICSGGLEEAARQFIGPGTRLTVL

SEQ ID NO: 235 - protein, 271 aa, Homo sapiens
MAKSLRVLLVILWLQLSWVWSQQKEVEQDPGPLSVPEGAIVSLNCTYSNSAFQYFMWYRQYSRKGPELLMYTYSSGNKEDGRFTAQVDKSSKYISLFIRDSQPSDSATYLCAMTSPYNNNDMRFGAGTRLTVKPNIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSS

SEQ ID NO: 236 - protein, 313 aa, Homo sapiens
MHLLLLLLGPGISLLLPGSLAGSGLGAVVSQHPSWVICKSGTSVKIECRSLDFQATTMFWYRQFPKQSLMLMATSNEGSKATYEQGVEKDKFLINHASLTLSTLTVTSAHPEDSSFYICSGGLEEAARQFIGPGTRLTVLEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 237 - protein, 6 aa, Homo sapiens
NSAFQY

SEQ ID NO: 238 - protein, 6 aa, Homo sapiens
TYSSGN

SEQ ID NO: 239 - protein, 14 aa, Homo sapiens
CAMTSPYNNNDMRF

SEQ ID NO: 240 - protein, 6 aa, Homo sapiens
DFQATT

SEQ ID NO: 241 - protein, 7 aa, Homo sapiens
SNEGSKA

SEQ ID NO: 242 - protein, 13 aa, Homo sapiens
CSGGLEEAARQFI

SEQ ID NO: 243 - protein, 134 aa, Homo sapiens; identical to SEQ ID NO: 233

SEQ ID NO: 244 - protein, 130 aa, Homo sapiens
MHLLLLLLGPAGSGLGAVVSQHPSRVICKSGTSVKIECRSLDFQATTMFWYRQFPKQSLMLMATSNEGSKATYEQGVEKDKFLINHASLTLSTLTVTSAHPEDSSFYICSGGLEEAARQFIGPGTRLTVL

SEQ ID NO: 245 - protein, 271 aa, Homo sapiens; identical to SEQ ID NO: 235

SEQ ID NO: 246 - protein, 303 aa, Homo sapiens
MHLLLLLLGPAGSGLGAVVSQHPSRVICKSGTSVKIECRSLDFQATTMFWYRQFPKQSLMLMATSNEGSKATYEQGVEKDKFLINHASLTLSTLTVTSAHPEDSSFYICSGGLEEAARQFIGPGTRLTVLEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 247 - protein, 7 aa, Homo sapiens
TISGNEY

SEQ ID NO: 248 - protein, 5 aa, Homo sapiens
GLKNN

SEQ ID NO: 249 - protein, 11 aa, Homo sapiens
CIVPNDYKLSF

SEQ ID NO: 250 - protein, 5 aa, Homo sapiens
MDHEN

SEQ ID NO: 251 - protein, 6 aa, Homo sapiens
SYDVKM

SEQ ID NO: 252 - protein, 16 aa, Homo sapiens
CASSFGTGSIQETQYF

SEQ ID NO: 253 - protein, 125 aa, Homo sapiens
MALVARVTVFLTFGTIIDAKTTQPPSMDCAEGRAANLPCNHSTISGNEYVYWYRQIHSQGPQYIIHGLKNNETNEMASLIITEDRKSSTLILPHATLRDTAVYYCIVPNDYKLSFGAGTTVTVRA

SEQ ID NO: 254 - protein, 134 aa, Homo sapiens
MHIRLLCRVAFCFLAVGLVDVKVTQSSRYLVKRTGEKVFLECVQDMDHENMFWYRQDPGLGLRLIYFSYDVKMKEKGDIPEGYSVSREKKERFSLILESASTNQTSMYLCASSFGTGSIQETQYFGPGTRLLVL

SEQ ID NO: 255 - protein, 262 aa, Homo sapiens
MALVARVTVFLTFGTIIDAKTTQPPSMDCAEGRAANLPCNHSTISGNEYVYWYRQIHSQGPQYIIHGLKNNETNEMASLIITEDRKSSTLILPHATLRDTAVYYCIVPNDYKLSFGAGTTVTVRANIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSS

SEQ ID NO: 256 - protein, 307 aa, Homo sapiens
MHIRLLCRVAFCFLAVGLVDVKVTQSSRYLVKRTGEKVFLECVQDMDHENMFWYRQDPGLGLRLIYFSYDVKMKEKGDIPEGYSVSREKKERFSLILESASTNQTSMYLCASSFGTGSIQETQYFGPGTRLLVLEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 257 - protein, 6 aa, Homo sapiens
ATGYPS

SEQ ID NO: 258 - protein, 7 aa, Homo sapiens
ATKADDK

SEQ ID NO: 259 - protein, 17 aa, Homo sapiens
CALNPNAGGTSYGKLTF

SEQ ID NO: 260 - protein, 5 aa, Homo sapiens
SGHTS

SEQ ID NO: 261 - protein, 6 aa, Homo sapiens
YDEGEE

SEQ ID NO: 262 - protein, 20 aa, Homo sapiens
CASSSPGATSGGANTGELFF

SEQ ID NO: 263 - protein, 135 aa, Homo sapiens
MAYSPGLVSLILLLLGRTRGNSVTQMEGPVTLSEEAFLTINCTYTATGYPSLFWYVQYPGEGLQLLLKATKADDKGSNKGFEATYRKETTSFHLEKGSVQVSDSAVYFCALNPNAGGTSYGKLTFGQGTILTVHP

SEQ ID NO: 264 - protein, 138 aa, Homo sapiens
MHPRLLFWALLCLLGTGPVEAGVTQSPTHLIKTRGQQATLRCSPISGHTSVYWYQQALGLGLQFLLWYDEGEERNRGNFPPRFSGRQFPNYSSELNVNALELEDSALYLCASSSPGATSGGANTGELFFGEGSRLTVL

SEQ ID NO: 265 - protein, 272 aa, Homo sapiens
MAYSPGLVSLILLLLGRTRGNSVTQMEGPVTLSEEAFLTINCTYTATGYPSLFWYVQYPGEGLQLLLKATKADDKGSNKGFEATYRKETTSFHLEKGSVQVSDSAVYFCALNPNAGGTSYGKLTFGQGTILTVHPNIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSS

SEQ ID NO: 266 - protein, 311 aa, Homo sapiens
MHPRLLFWALLCLLGTGPVEAGVTQSPTHLIKTRGQQATLRCSPISGHTSVYWYQQALGLGLQFLLWYDEGEERNRGNFPPRFSGRQFPNYSSELNVNALELEDSALYLCASSSPGATSGGANTGELFFGEGSRLTVLEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 267 - protein, 6 aa, Homo sapiens
DSSSTY

SEQ ID NO: 268 - protein, 7 aa, Homo sapiens
IFSNMDM

SEQ ID NO: 269 - protein, 17 aa, Homo sapiens
CAEIPRDSGGGADGLTF

SEQ ID NO: 270 - protein, 6 aa, Homo sapiens
DFQATT

SEQ ID NO: 271 - protein, 7 aa, Homo sapiens
SNEGSKA

SEQ ID NO: 272 - protein, 14 aa, Homo sapiens
CSARDLQRSYEQYF

SEQ ID NO: 273 - protein, 136 aa, Homo sapiens
MATFAGFSFLFLWLQLDCMSRGEDVEQSLFLSVREGDSSVINCTYTDSSSTYLYWYKQEPGAGLQLLTYIFSNMDMKQDQRLTVLLNKKDKHLSLRIADTQTGDSAIYFCAEIPRDSGGGADGLTFGKGTHLIIQP

SEQ ID NO: 274 - protein, 141 aa, Homo sapiens
MHLLLLLLGPGISLLLPGSLAGSGLGAVVSQHPSWVICKSGTSVKIECRSLDFQATTMFWYRQFPKQSLMLMATSNEGSKATYEQGVEKDKFLINHASLTLSTLTVTSAHPEDSSFYICSARDLQRSYEQYFGPGTRLTVT

SEQ ID NO: 275 - protein, 273 aa, Homo sapiens
MATFAGFSFLFLWLQLDCMSRGEDVEQSLFLSVREGDSSVINCTYTDSSSTYLYWYKQEPGAGLQLLTYIFSNMDMKQDQRLTVLLNKKDKHLSLRIADTQTGDSAIYFCAEIPRDSGGGADGLTFGKGTHLIIQPNIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSS

SEQ ID NO: 276 - protein, 314 aa, Homo sapiens
MHLLLLLLGPGISLLLPGSLAGSGLGAVVSQHPSWVICKSGTSVKIECRSLDFQATTMFWYRQFPKQSLMLMATSNEGSKATYEQGVEKDKFLINHASLTLSTLTVTSAHPEDSSFYICSARDLQRSYEQYFGPGTRLTVTEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 277 - protein, 6 aa, Homo sapiens
DSSSTY

SEQ ID NO: 278 - protein, 7 aa, Homo sapiens
IFSNMDM

SEQ ID NO: 279 - protein, 17 aa, Homo sapiens
CAEIPRDSGGGADGLTF

SEQ ID NO: 280 - protein, 6 aa, Homo sapiens
DFQATT

SEQ ID NO: 281 - protein, 7 aa, Homo sapiens
SNEGSKA

SEQ ID NO: 282 - protein, 14 aa, Homo sapiens
CSARDLQRSYEQYF

SEQ ID NO: 283 - protein, 136 aa, Homo sapiens; identical to SEQ ID NO: 273

SEQ ID NO: 284 - protein, 131 aa, Homo sapiens
MHLLLLLLGPAGSGLGAVVSQHPSRVICKSGTSVKIECRSLDFQATTMFWYRQFPKQSLMLMATSNEGSKATYEQGVEKDKFLINHASLTLSTLTVTSAHPEDSSFYICSARDLQRSYEQYFGPGTRLTVT

SEQ ID NO: 285 - protein, 273 aa, Homo sapiens; identical to SEQ ID NO: 275

SEQ ID NO: 286 - protein, 304 aa, Homo sapiens
MHLLLLLLGPAGSGLGAVVSQHPSRVICKSGTSVKIECRSLDFQATTMFWYRQFPKQSLMLMATSNEGSKATYEQGVEKDKFLINHASLTLSTLTVTSAHPEDSSFYICSARDLQRSYEQYFGPGTRLTVTEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 287 - protein, 6 aa, Homo sapiens
NSASDY

SEQ ID NO: 288 - protein, 7 aa, Homo sapiens
IRSNMDK

SEQ ID NO: 289 - protein, 16 aa, Homo sapiens
CAEPVGGLNSGYALNF

SEQ ID NO: 290 - protein, 5 aa, Homo sapiens
SGHKS

SEQ ID NO: 291 - protein, 6 aa, Homo sapiens
YYEKEE

SEQ ID NO: 292 - protein, 16 aa, Homo sapiens
CASSGGRTSGAYEQFF

SEQ ID NO: 293 - protein, 135 aa, Homo sapiens
MAGIRALFMYLWLQLDWVSRGESVGLHLPTLSVQEGDNSIINCAYSNSASDYFIWYKQESGKGPQFIIDIRSNMDKRQGQRVTVLLNKTVKHLSLQIAATQPGDSAVYFCAEPVGGLNSGYALNFGKGTSLLVTP

SEQ ID NO: 294 - protein, 134 aa, Homo sapiens
MHPGLLCWVLLCLLGAGPVDAGVTQSPTHLIKTRGQQVTLRCSPISGHKSVSWYQQVLGQGPQFIFQYYEKEERGRGNFPDRFSARQFPNYSSELNVNALLLGDSALYLCASSGGRTSGAYEQFFGPGTRLTVL

SEQ ID NO: 295 - protein, 272 aa, Homo sapiens
MAGIRALFMYLWLQLDWVSRGESVGLHLPTLSVQEGDNSIINCAYSNSASDYFIWYKQESGKGPQFIIDIRSNMDKRQGQRVTVLLNKTVKHLSLQIAATQPGDSAVYFCAEPVGGLNSGYALNFGKGTSLLVTPNIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSS

SEQ ID NO: 296 - protein, 307 aa, Homo sapiens
MHPGLLCWVLLCLLGAGPVDAGVTQSPTHLIKTRGQQVTLRCSPISGHKSVSWYQQVLGQGPQFIFQYYEKEERGRGNFPDRFSARQFPNYSSELNVNALLLGDSALYLCASSGGRTSGAYEQFFGPGTRLTVLEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 297 - protein, 6 aa, Homo sapiens
VSGLRG

SEQ ID NO: 298 - protein, 7 aa, Homo sapiens
LYSAGEE

SEQ ID NO: 299 - protein, 16 aa, Homo sapiens
CAVTAHRGSTLGRLYF

SEQ ID NO: 300 - protein, 5 aa, Homo sapiens
SGHDT

SEQ ID NO: 301 - protein, 6 aa, Homo sapiens
YYEEEE

SEQ ID NO: 302 - protein, 15 aa, Homo sapiens
CASSRRGGAYNEQFF

SEQ ID NO: 303 - protein, 134 aa, Homo sapiens
MAKMLECAFIVLWLQLGWLSGEDQVTQSPEALRLQEGESSSLNCSYTVSGLRGLFWYRQDPGKGPEFLFTLYSAGEEKEKERLKATLTKKESFLHITAPKPEDSATYLCAVTAHRGSTLGRLYFGRGTQLTVWP

SEQ ID NO: 304 - protein, 133 aa, Homo sapiens
MHPGLLCWALLCLLGAGLVDAGVTQSPTHLIKTRGQQVTLRCSPKSGHDTVSWYQQALGQGPQFIFQYYEEEERQRGNFPDRFSGHQFPNYSSELNVNALLLGDSALYLCASSRRGGAYNEQFFGPGTRLTVL

SEQ ID NO: 305 - protein, 271 aa, Homo sapiens
MAKMLECAFIVLWLQLGWLSGEDQVTQSPEALRLQEGESSSLNCSYTVSGLRGLFWYRQDPGKGPEFLFTLYSAGEEKEKERLKATLTKKESFLHITAPKPEDSATYLCAVTAHRGSTLGRLYFGRGTQLTVWPNIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSS

SEQ ID NO: 306 - protein, 306 aa, Homo sapiens
MHPGLLCWALLCLLGAGLVDAGVTQSPTHLIKTRGQQVTLRCSPKSGHDTVSWYQQALGQGPQFIFQYYEEEERQRGNFPDRFSGHQFPNYSSELNVNALLLGDSALYLCASSRRGGAYNEQFFGPGTRLTVLEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 307 - protein, 6 aa, Homo sapiens
SSNFYA

SEQ ID NO: 308 - protein, 7 aa, Homo sapiens
MTLNGDE

SEQ ID NO: 309 - protein, 13 aa, Homo sapiens
CASVGGGADGLTF

SEQ ID NO: 310 - protein, 5 aa, Homo sapiens
SGHTA

SEQ ID NO: 311 - protein, 6 aa, Homo sapiens
FQGNSA

SEQ ID NO: 312 - protein, 15 aa, Homo sapiens
CASTWDRGSYNEQFF

SEQ ID NO: 313 - protein, 134 aa, Homo sapiens
MAKNPLAAPLLILWFHLDCVSSILNVEQSPQSLHVQEGDSTNFTCSFPSSNFYALHWYRWETAKSPEALFVMTLNGDEKKKGRISATLNTKEGYSYLYIKGSQPEDSATYLCASVGGGADGLTFGKGTHLIIQP

SEQ ID NO: 314 - protein, 134 aa, Homo sapiens
MHTRLLFWVAFCLLGADHTGAGVSQSPSNKVTEKGKDVELRCDPISGHTALYWYRQSLGQGLEFLIYFQGNSAPDKSGLPSDRFSAERTGGSVSTLTIQRTQQEDSAVYLCASTWDRGSYNEQFFGPGTRLTVL

SEQ ID NO: 315 - protein, 271 aa, Homo sapiens
MAKNPLAAPLLILWFHLDCVSSILNVEQSPQSLHVQEGDSTNFTCSFPSSNFYALHWYRWETAKSPEALFVMTLNGDEKKKGRISATLNTKEGYSYLYIKGSQPEDSATYLCASVGGGADGLTFGKGTHLIIQPNIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSS

SEQ ID NO: 316 - protein, 307 aa, Homo sapiens
MHTRLLFWVAFCLLGADHTGAGVSQSPSNKVTEKGKDVELRCDPISGHTALYWYRQSLGQGLEFLIYFQGNSAPDKSGLPSDRFSAERTGGSVSTLTIQRTQQEDSAVYLCASTWDRGSYNEQFFGPGTRLTVLEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 317 - protein, 6 aa, Homo sapiens
NSMFDY

SEQ ID NO: 318 - protein, 7 aa, Homo sapiens
ISSIKDK

SEQ ID NO: 319 - protein, 11 aa, Homo sapiens
CAANTGNQFYF

SEQ ID NO: 320 - protein, 5 aa, Homo sapiens
SGHAT

SEQ ID NO: 321 - protein, 6 aa, Homo sapiens
FQNNGV

SEQ ID NO: 322 - protein, 16 aa, Homo sapiens
CASSHLAGEFYNEQFF

SEQ ID NO: 323 - protein, 136 aa, Homo sapiens
MAMLLGASVLILWLQPDWVNSQQKNDDQQVKQNSPSLSVQEGRISILNCDYTNSMFDYFLWYKKYPAEGPTFLISISSIKDKNEDGRFTVFLNKSAKHLSLHIVPSQPGDSAVYFCAANTGNQFYFGTGTSLTVIP

SEQ ID NO: 324 - protein, 135 aa, Homo sapiens
MHTRLLCWAALCLLGAELTEAGVAQSPRYKIIEKRQSVAFWCNPISGHATLYWYQQILGQGPKLLIQFQNNGVVDDSQLPKDRFSAERLKGVDSTLKIQPAKLEDSAVYLCASSHLAGEFYNEQFFGPGTRLTVL

SEQ ID NO: 325 - protein, 273 aa, Homo sapiens
MAMLLGASVLILWLQPDWVNSQQKNDDQQVKQNSPSLSVQEGRISILNCDYTNSMFDYFLWYKKYPAEGPTFLISISSIKDKNEDGRFTVFLNKSAKHLSLHIVPSQPGDSAVYFCAANTGNQFYFGTGTSLTVIPNIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSS

SEQ ID NO: 326 - protein, 308 aa, Homo sapiens
MHTRLLCWAALCLLGAELTEAGVAQSPRYKIIEKRQSVAFWCNPISGHATLYWYQQILGQGPKLLIQFQNNGVVDDSQLPKDRFSAERLKGVDSTLKIQPAKLEDSAVYLCASSHLAGEFYNEQFFGPGTRLTVLEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 327 - protein, 6 aa, Homo sapiens
TSGFYG

SEQ ID NO: 328 - protein, 6 aa, Homo sapiens
NALDGL

SEQ ID NO: 329 - protein, 11 aa, Homo sapiens
CAFAYGQNFVF

SEQ ID NO: 330 - protein, 5 aa, Homo sapiens
SGDLS

SEQ ID NO: 331 - protein, 6 aa, Homo sapiens
YYNGEE

SEQ ID NO: 332 - protein, 15 aa, Homo sapiens
CASSPLGDSGNTIYF

SEQ ID NO: 333 - protein, 125 aa, Homo sapiens
MAGAFLLYVSMKMGGTAGQSLEQPSEVTAVEGAIVQINCTYQTSGFYGLSWYQQHDGGAPTFLSYNALDGLEETGRFSSFLSRSDSYGYLLLQELQMKDSASYFCAFAYGQNFVFGPGTRLSVLP

SEQ ID NO: 334 - protein, 133 aa, Homo sapiens
MHFRLLCCVAFCLLGAGPVDSGVTQTPKHLITATGQRVTLRCSPRSGDLSVYWYQQSLDQGLQFLIQYYNGEERAKGNILERFSAQQFPDLHSELNLSSLELGDSALYFCASSPLGDSGNTIYFGEGSWLTVV

SEQ ID NO: 335 - protein, 262 aa, Homo sapiens
MAGAFLLYVSMKMGGTAGQSLEQPSEVTAVEGAIVQINCTYQTSGFYGLSWYQQHDGGAPTFLSYNALDGLEETGRFSSFLSRSDSYGYLLLQELQMKDSASYFCAFAYGQNFVFGPGTRLSVLPNIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSS

SEQ ID NO: 336 - protein, 306 aa, Homo sapiens
MHFRLLCCVAFCLLGAGPVDSGVTQTPKHLITATGQRVTLRCSPRSGDLSVYWYQQSLDQGLQFLIQYYNGEERAKGNILERFSAQQFPDLHSELNLSSLELGDSALYFCASSPLGDSGNTIYFGEGSWLTVVEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 337 - protein, 5 aa, Homo sapiens
TSINN

SEQ ID NO: 338 - protein, 7 aa, Homo sapiens
IRSNERE

SEQ ID NO: 339 - protein, 12 aa, Homo sapiens
CATDAWNNDMRF

SEQ ID NO: 340 - protein, 5 aa, Homo sapiens
MNHNS

SEQ ID NO: 341 - protein, 6 aa, Homo sapiens
SASEGT

SEQ ID NO: 342 - protein, 14 aa, Homo sapiens
CASSESQGNTEAFF

SEQ ID NO: 343 - protein, 130 aa, Homo sapiens
MATLLGVSLVILWLQLARVNSQQGEEDPQALSIQEGENATMNCSYKTSINNLQWYRQNSGRGLVHLILIRSNEREKHSGRLRVTLDTSKKSSSLLITASRAADTASYFCATDAWNNDMRFGAGTRLTVKP

SEQ ID NO: 344 - protein, 132 aa, Homo sapiens
MHIGLLCCVAFSLLWASPVNAGVTQTPKFQVLKTGQSMTLQCAQDMNHNSMYWYRQDPGMGLRLIYYSASEGTTDKGEVPNGYNVSRLNKREFSLRLESAAPSQTSVYFCASSESQGNTEAFFGQGTRLTVV

SEQ ID NO: 345 - protein, 267 aa, Homo sapiens
MATLLGVSLVILWLQLARVNSQQGEEDPQALSIQEGENATMNCSYKTSINNLQWYRQNSGRGLVHLILIRSNEREKHSGRLRVTLDTSKKSSSLLITASRAADTASYFCATDAWNNDMRFGAGTRLTVKPNIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSS

SEQ ID NO: 346 - protein, 305 aa, Homo sapiens
MHIGLLCCVAFSLLWASPVNAGVTQTPKFQVLKTGQSMTLQCAQDMNHNSMYWYRQDPGMGLRLIYYSASEGTTDKGEVPNGYNVSRLNKREFSLRLESAAPSQTSVYFCASSESQGNTEAFFGQGTRLTVVEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 347 - protein, 6 aa, Homo sapiens
VSPFSN

SEQ ID NO: 348 - protein, 7 aa, Homo sapiens
MTFSENT

SEQ ID NO: 349 - protein, 10 aa, Homo sapiens
CVVSSYKIIF

SEQ ID NO: 350 - protein, 5 aa, Homo sapiens
SGHTA

SEQ ID NO: 351 - protein, 6 aa, Homo sapiens
FQGNSA

SEQ ID NO: 352 - protein, 15 aa, Homo sapiens
CASSPIQGENSPLHF

SEQ ID NO: 353 - protein, 130 aa, Homo sapiens
MAKHLTTFLVILWLYFYRGNGKNQVEQSPQSLIILEGKNCTLQCNYTVSPFSNLRWYKQDTGRGPVSLTIMTFSENTKSNGRYTATLDADTKQSSLHITASQLSDSASYICVVSSYKIIFGTGTRLHVFP

SEQ ID NO: 354 - protein, 134 aa, Homo sapiens
MHTRLLFWVAFCLLGAYHTGAGVSQSPSNKVTEKGKDVELRCDPISGHTALYWYRQRLGQGLEFLIYFQGNSAPDKSGLPSDRFSAERTGESVSTLTIQRTQQEDSAVYLCASSPIQGENSPLHFGNGTRLTVT

SEQ ID NO: 355 - protein, 267 aa, Homo sapiens
MAKHLTTFLVILWLYFYRGNGKNQVEQSPQSLIILEGKNCTLQCNYTVSPFSNLRWYKQDTGRGPVSLTIMTFSENTKSNGRYTATLDADTKQSSLHITASQLSDSASYICVVSSYKIIFGTGTRLHVFPNIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSS

SEQ ID NO: 356 - protein, 307 aa, Homo sapiens
MHTRLLFWVAFCLLGAYHTGAGVSQSPSNKVTEKGKDVELRCDPISGHTALYWYRQRLGQGLEFLIYFQGNSAPDKSGLPSDRFSAERTGESVSTLTIQRTQQEDSAVYLCASSPIQGENSPLHFGNGTRLTVTEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 357 - protein, 6 aa, Homo sapiens
VSPFSN

SEQ ID NO: 358 - protein, 7 aa, Homo sapiens
MTFSENT

SEQ ID NO: 359 - protein, 11 aa, Homo sapiens
ICVVSSYKLIF

SEQ ID NO: 360 - protein, 5 aa, Homo sapiens
SGHTA

SEQ ID NO: 361 - protein, 6 aa, Homo sapiens
FQGNSA

SEQ ID NO: 362 - protein, 15 aa, Homo sapiens
CASSPIQGENSPLHF

SEQ ID NO: 363 - protein, 130 aa, Homo sapiens
MAKHLTTFLVILWLYFYRGNGKNQVEQSPQSLIILEGKNCTLQCNYTVSPFSNLRWYKQDTGRGPVSLTIMTFSENTKSNGRYTATLDADTKQSSLHITASQLSDSASYICVVSSYKLIFGTGTRLQVFP

SEQ ID NO: 364 - protein, 134 aa, Homo sapiens; identical to SEQ ID NO: 354

SEQ ID NO: 365 - protein, 267 aa, Homo sapiens
MAKHLTTFLVILWLYFYRGNGKNQVEQSPQSLIILEGKNCTLQCNYTVSPFSNLRWYKQDTGRGPVSLTIMTFSENTKSNGRYTATLDADTKQSSLHITASQLSDSASYICVVSSYKLIFGTGTRLQVFPNIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSS

SEQ ID NO: 366 - protein, 307 aa, Homo sapiens; identical to SEQ ID NO: 356

SEQ ID NO: 367 - protein, 6 aa, Homo sapiens
SSVSVY

SEQ ID NO: 368 - protein, 8 aa, Homo sapiens
YLSGSTLV

SEQ ID NO: 369 - protein, 14 aa, Homo sapiens
CAVSKGTGAQKLVF

SEQ ID NO: 370 - protein, 5 aa, Homo sapiens
LNHDA

SEQ ID NO: 371 - protein, 6 aa, Homo sapiens
SQIVND

SEQ ID NO: 372 - protein, 7 aa, Homo sapiens
CASEAFF

SEQ ID NO: 373 - protein, 133 aa, Homo sapiens
MALLLVPAFQVIFTLGGTRAQSVTQLDSQVPVFEEAPVELRCNYSSSVSVYLFWYVQYPNQGLQLLLKYLSGSTLVESINGFEAEFNKSQTSFHLRKPSVHISDTAEYFCAVSKGTGAQKLVFGQGTRLTINP

SEQ ID NO: 374 - protein, 125 aa, Homo sapiens
MHNQVLCCVVLCFLGANTVDGGITQSPKYLFRKEGQNVTLSCEQNLNHDAMYWYRQDPGQGLRLIYYSQIVNDFQKGDIAEGYSVSREKKESFPLIVTSAQKNPTASYLCASEAFFGQGTRLTVV

SEQ ID NO: 375 - protein, 270 aa, Homo sapiens
MALLLVPAFQVIFTLGGTRAQSVTQLDSQVPVFEEAPVELRCNYSSSVSVYLFWYVQYPNQGLQLLLKYLSGSTLVESINGFEAEFNKSQTSFHLRKPSVHISDTAEYFCAVSKGTGAQKLVFGQGTRLTINPNIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSS

SEQ ID NO: 376 - protein, 298 aa, Homo sapiens
MHNQVLCCVVLCFLGANTVDGGITQSPKYLFRKEGQNVTLSCEQNLNHDAMYWYRQDPGQGLRLIYYSQIVNDFQKGDIAEGYSVSREKKESFPLIVTSAQKNPTASYLCASEAFFGQGTRLTVVEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 377 - protein, 7 aa, Homo sapiens
TISGTDY

SEQ ID NO: 378 - protein, 5 aa, Homo sapiens
GLTSN

SEQ ID NO: 379 - protein, 14 aa, Homo sapiens
CILASGAGSYQLTF

SEQ ID NO: 380 - protein, 5 aa, Homo sapiens
LGHDT

SEQ ID NO: 381 - protein, 6 aa, Homo sapiens
YNNKEL

SEQ ID NO: 382 - protein, 14 aa, Homo sapiens
CASRTIGYNTEAFF

SEQ ID NO: 383 - protein, 128 aa, Homo sapiens
MALVTSITVLLSLGIMGDAKTTQPNSMESNEEEPVHLPCNHSTISGTDYIHWYRQLPSQGPEYVIHGLTSNVNNRMASLAIAEDRKSSTLILHRATLRDAAVYYCILASGAGSYQLTFGKGTKLSVIP

SEQ ID NO: 384 - protein, 132 aa, Homo sapiens
MHCRLLCCVVFCLLQAGPLDTAVSQTPKYLVTQMGNDKSIKCEQNLGHDTMYWYKQDSKKFLKIMFSYNNKELIINETVPNRFSPKSPDKAHLNLHINSLELGDSAVYFCASRTIGYNTEAFFGQGTRLTVV

SEQ ID NO: 385 - protein, 265 aa, Homo sapiens
MALVTSITVLLSLGIMGDAKTTQPNSMESNEEEPVHLPCNHSTISGTDYIHWYRQLPSQGPEYVIHGLTSNVNNRMASLAIAEDRKSSTLILHRATLRDAAVYYCILASGAGSYQLTFGKGTKLSVIPNIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSS

SEQ ID NO: 386 - protein, 305 aa, Homo sapiens
MHCRLLCCVVFCLLQAGPLDTAVSQTPKYLVTQMGNDKSIKCEQNLGHDTMYWYKQDSKKFLKIMFSYNNKELIINETVPNRFSPKSPDKAHLNLHINSLELGDSAVYFCASRTIGYNTEAFFGQGTRLTVVEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 387 - protein, 5 aa, Homo sapiens
VGISA

SEQ ID NO: 388 - protein, 5 aa, Homo sapiens
LSSGK

SEQ ID NO: 389 - protein, 13 aa, Homo sapiens
CAALSYNTDKLIF

SEQ ID NO: 390 - protein, 5 aa, Homo sapiens
SGHTA

SEQ ID NO: 391 - protein, 6 aa, Homo sapiens
FQGTGA

SEQ ID NO: 392 - protein, 15 aa, Homo sapiens
CASSLSGLLQETQYF

SEQ ID NO: 393 - protein, 131 aa, Homo sapiens
MAKIRQFLLAILWLQLSCVSAAKNEVEQSPQNLTAQEGEFITINCSYSVGISALHWLQQHPGGGIVSLFMLSSGKKKHGRLIATINIQEKHSSLHITASHPRDSAVYICAALSYNTDKLIFGTGTRLQVFP

SEQ ID NO: 394 - protein, 134 aa, Homo sapiens
MHTRLLCWAALCLLGADHTGAGVSQTPSNKVTEKGKYVELRCDPISGHTALYWYRQSLGQGPEFLIYFQGTGAADDSGLPNDRFFAVRPEGSVSTLKIQRTERGDSAVYLCASSLSGLLQETQYFGPGTRLLVL

SEQ ID NO: 395 - protein, 268 aa, Homo sapiens
MAKIRQFLLAILWLQLSCVSAAKNEVEQSPQNLTAQEGEFITINCSYSVGISALHWLQQHPGGGIVSLFMLSSGKKKHGRLIATINIQEKHSSLHITASHPRDSAVYICAALSYNTDKLIFGTGTRLQVFPNIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSS

SEQ ID NO: 396 - protein, 307 aa, Homo sapiens
MHTRLLCWAALCLLGADHTGAGVSQTPSNKVTEKGKYVELRCDPISGHTALYWYRQSLGQGPEFLIYFQGTGAADDSGLPNDRFFAVRPEGSVSTLKIQRTERGDSAVYLCASSLSGLLQETQYFGPGTRLLVLEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 397 - protein, 6 aa, Homo sapiens
ATGYPS

SEQ ID NO: 398 - protein, 7 aa, Homo sapiens
ATKADDK

SEQ ID NO: 399 - protein, 16 aa, Homo sapiens
CALSHTGSSNTGKLIF

SEQ ID NO: 400 - protein, 5 aa, Homo sapiens
SGHAT

SEQ ID NO: 401 - protein, 6 aa, Homo sapiens
FQNNGV

SEQ ID NO: 402 - protein, 15 aa, Homo sapiens
CASSTGGGRHQPQHF

SEQ ID NO: 403 - protein, 134 aa, Homo sapiens
MAYSPGLVSLILLLLGRTRGNSVTQMEGPVTLSEEAFLTINCTYTATGYPSLFWYVQYPGEGLQLLLKATKADDKGSNKGFEATYRKETTSFHLEKGSVQVSDSAVYFCALSHTGSSNTGKLIFGQGTRLQVKP

SEQ ID NO: 404 - protein, 134 aa, Homo sapiens
MHTRLLCWAALCLLGAELTEAGVAQSPRYKIIEKRQSVAFWCNPISGHATLYWYQQILGQGPKLLIQFQNNGVVDDSQLPKDRFSAERLKGVDSTLKIQPAKLEDSAVYLCASSTGGGRHQPQHFGDGTRLSIL

SEQ ID NO: 405 - protein, 271 aa, Homo sapiens
MAYSPGLVSLILLLLGRTRGNSVTQMEGPVTLSEEAFLTINCTYTATGYPSLFWYVQYPGEGLQLLLKATKADDKGSNKGFEATYRKETTSFHLEKGSVQVSDSAVYFCALSHTGSSNTGKLIFGQGTRLQVKPNIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSS

SEQ ID NO: 406 - protein, 307 aa, Homo sapiens
MHTRLLCWAALCLLGAELTEAGVAQSPRYKIIEKRQSVAFWCNPISGHATLYWYQQILGQGPKLLIQFQNNGVVDDSQLPKDRFSAERLKGVDSTLKIQPAKLEDSAVYLCASSTGGGRHQPQHFGDGTRLSILEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 407 - protein, 6 aa, Homo sapiens
ATGYPS

SEQ ID NO: 408 - protein, 7 aa, Homo sapiens
ATKADDK

SEQ ID NO: 409 - protein, 16 aa, Homo sapiens
CALSQTGSSKTGKLIF

SEQ ID NO: 410 - protein, 5 aa, Homo sapiens
SGHAT

SEQ ID NO: 411 - protein, 6 aa, Homo sapiens
FQNNGV

SEQ ID NO: 412 - protein, 15 aa, Homo sapiens
CASSTGGGRHQPQHF

SEQ ID NO: 413 - protein, 134 aa, Homo sapiens
MAYSPGLVSLILLLLGRTRGNSVTQMEGPVTLSEEAFLTINCTYTATGYPSLFWYVQYPGEGLQLLLKATKADDKGSNKGFEATYRKETTSFHLEKGSVQVSDSAVYFCALSQTGSSKTGKLIFGQGTRLQVKP

SEQ ID NO: 414 - protein, 134 aa, Homo sapiens; identical to SEQ ID NO: 404

SEQ ID NO: 415 - protein, 271 aa, Homo sapiens
MAYSPGLVSLILLLLGRTRGNSVTQMEGPVTLSEEAFLTINCTYTATGYPSLFWYVQYPGEGLQLLLKATKADDKGSNKGFEATYRKETTSFHLEKGSVQVSDSAVYFCALSQTGSSKTGKLIFGQGTRLQVKPNIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSS

SEQ ID NO: 416 - protein, 307 aa, Homo sapiens; identical to SEQ ID NO: 406

SEQ ID NO: 417 - protein, 6 aa, Homo sapiens
ATGYPS

SEQ ID NO: 418 - protein, 7 aa, Homo sapiens
ATKADDK

SEQ ID NO: 419 - protein, 16 aa, Homo sapiens
CALSQTGSSNTGKLIF

SEQ ID NO: 420 - protein, 5 aa, Homo sapiens
SGHAT

SEQ ID NO: 421 - protein, 6 aa, Homo sapiens
FQNNGV

SEQ ID NO: 422 - protein, 15 aa, Homo sapiens
CASSTGGGRHQPQHF

SEQ ID NO: 423 - protein, 134 aa, Homo sapiens
MAYSPGLVSLILLLLGRTRGNSVTQMEGPVTLSEEAFLTINCTYTATGYPSLFWYVQYPGEGLQLLLKATKADDKGSNKGFEATYRKETTSFHLEKGSVQVSDSAVYFCALSQTGSSNTGKLIFGQGTRLQVKP

SEQ ID NO: 424 - protein, 134 aa, Homo sapiens; identical to SEQ ID NO: 404

SEQ ID NO: 425 - protein, 271 aa, Homo sapiens
MAYSPGLVSLILLLLGRTRGNSVTQMEGPVTLSEEAFLTINCTYTATGYPSLFWYVQYPGEGLQLLLKATKADDKGSNKGFEATYRKETTSFHLEKGSVQVSDSAVYFCALSQTGSSNTGKLIFGQGTRLQVKPNIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSS

SEQ ID NO: 426 - protein, 307 aa, Homo sapiens; identical to SEQ ID NO: 406

SEQ ID NO: 427 - protein, 6 aa, Homo sapiens
ATGYPS

SEQ ID NO: 428 - protein, 7 aa, Homo sapiens
ATKADDK

SEQ ID NO: 429 - protein, 16 aa, Homo sapiens
CALSTTGSSNTGKLIF

SEQ ID NO: 430 - protein, 5 aa, Homo sapiens
SGHAT

SEQ ID NO: 431 - protein, 6 aa, Homo sapiens
FQNNGV

SEQ ID NO: 432 - protein, 15 aa, Homo sapiens
CASSTGGGRHQPQHF

SEQ ID NO: 433 - protein, 134 aa, Homo sapiens
MAYSPGLVSLILLLLGRTRGNSVTQMEGPVTLSEEAFLTINCTYTATGYPSLFWYVQYPGEGLQLLLKATKADDKGSNKGFEATYRKETTSFHLEKGSVQVSDSAVYFCALSTTGSSNTGKLIFGQGTTLQVKP

SEQ ID NO: 434 - protein, 134 aa, Homo sapiens; identical to SEQ ID NO: 404

SEQ ID NO: 435 - protein, 271 aa, Homo sapiens
MAYSPGLVSLILLLLGRTRGNSVTQMEGPVTLSEEAFLTINCTYTATGYPSLFWYVQYPGEGLQLLLKATKADDKGSNKGFEATYRKETTSFHLEKGSVQVSDSAVYFCALSTTGSSNTGKLIFGQGTTLQVKPNIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSS

SEQ ID NO: 436 - protein, 307 aa, Homo sapiens; identical to SEQ ID NO: 406

SEQ ID NO: 437 - protein, 6 aa, Homo sapiens
DRGSQS

SEQ ID NO: 438 - protein, 6 aa, Homo sapiens
IYSNGD

SEQ ID NO: 439 - protein, 14 aa, Homo sapiens
CAVTLCGGYNKLIF

SEQ ID NO: 440 - protein, 5 aa, Homo sapiens
LNHDA

SEQ ID NO: 441 - protein, 6 aa, Homo sapiens
SQIVND

SEQ ID NO: 442 - protein, 12 aa, Homo sapiens
CASSSRDYEQYF

SEQ ID NO: 443 - protein, 133 aa, Homo sapiens
MASLRVLLVILWLQLSWVWSQQKEVEQNSGPLSVPEGAIASLNCTYSDRGSQSFFWYRQYSGKSPELIMFIYSNGDKEDGRFTAQLNKASQYVSLLIRDSQPSDSATYLCAVTLCGGYNKLIFGAGTRLAVHP

SEQ ID NO: 444 - protein, 130 aa, Homo sapiens
MHNQVLCCVVLCFLGANTVDGGITQSPKYLFRKEGQNVTLSCEQNLNHDAMYWYRQDPGQGLRLIYYSQIVNDFQKGDIVEGYSVSREKKESFPLTVTSAQKNPTAFYLCASSSRDYEQYFGPGTRLTVT

SEQ ID NO: 445 - protein, 270 aa, Homo sapiens
MASLRVLLVILWLQLSWVWSQQKEVEQNSGPLSVPEGAIASLNCTYSDRGSQSFFWYRQYSGKSPELIMFIYSNGDKEDGRFTAQLNKASQYVSLLIRDSQPSDSATYLCAVTLCGGYNKLIFGAGTRLAVHPNIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSS

SEQ ID NO: 446 - protein, 303 aa, Homo sapiens
MHNQVLCCVVLCFLGANTVDGGITQSPKYLFRKEGQNVTLSCEQNLNHDAMYWYRQDPGQGLRLIYYSQIVNDFQKGDIVEGYSVSREKKESFPLTVTSAQKNPTAFYLCASSSRDYEQYFGPGTRLTVTEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 447 - protein, 6 aa, Homo sapiens
DRGSQS

SEQ ID NO: 448 - protein, 6 aa, Homo sapiens
IYSNGD

SEQ ID NO: 449 - protein, 14 aa, Homo sapiens
CAVTLSGGYNKLIF

SEQ ID NO: 450 - protein, 5 aa, Homo sapiens
LNHDA

SEQ ID NO: 451 - protein, 6 aa, Homo sapiens
SQIVND

SEQ ID NO: 452 - protein, 12 aa, Homo sapiens
CASSSRDYEQYF

SEQ ID NO: 453 - protein, 133 aa, Homo sapiens
MASLRVLLVILWLQLSWVWSQQKEVEQNSGPLSVPEGAIASLNCTYSDRGSQSFFWYRQYSGKSPELIMFIYSNGDKEDGRFTAQLNKASQYVSLLIRDSQPSDSATYLCAVTLSGGYNKLIFGAGTRLAVHP

SEQ ID NO: 454 - protein, 130 aa, Homo sapiens; identical to SEQ ID NO: 444

SEQ ID NO: 455 - protein, 270 aa, Homo sapiens
MASLRVLLVILWLQLSWVWSQQKEVEQNSGPLSVPEGAIASLNCTYSDRGSQSFFWYRQYSGKSPELIMFIYSNGDKEDGRFTAQLNKASQYVSLLIRDSQPSDSATYLCAVTLSGGYNKLIFGAGTRLAVHPNIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSS

SEQ ID NO: 456 - protein, 303 aa, Homo sapiens; identical to SEQ ID NO: 446

SEQ ID NO: 457 - protein, 6 aa, Homo sapiens
DRGSQS

SEQ ID NO: 458 - protein, 6 aa, Homo sapiens
IYSNGD

SEQ ID NO: 459 - protein, 12 aa, Homo sapiens
CAVNDAGNMLTF

SEQ ID NO: 460 - protein, 6 aa, Homo sapiens
DFQATT

SEQ ID NO: 461 - protein, 7 aa, Homo sapiens
SNEGSKA

SEQ ID NO: 462 - protein, 13 aa, Homo sapiens
CSAAGQANTEAFF

SEQ ID NO: 463 - protein, 131 aa, Homo sapiens
MHSLRVLLVILWLQLSWVWSQQKEVEQNSGPLSVPEGAIASLNCTYSDRGSQSFFWYRQYSGKSPELIMFIYSNGDKEDGRFTAQLNKASQYVSLLIRDSQPSDSATYLCAVNDAGNMLTFGGGTRLMVKP

SEQ ID NO: 464 - protein, 140 aa, Homo sapiens
MALLLLLLGPGISLLLPGSLAGSGLGAVVSQHPSWVICKSGTSVKIECRSLDFQATTMFWYRQFPKQSLMLMATSNEGSKATYEQGVEKDKFLINHASLTLSTLTVTSAHPEDSSFYICSAAGQANTEAFFGQGTRLTVV

SEQ ID NO: 465 - protein, 268 aa, Homo sapiens
MHSLRVLLVILWLQLSWVWSQQKEVEQNSGPLSVPEGAIASLNCTYSDRGSQSFFWYRQYSGKSPELIMFIYSNGDKEDGRFTAQLNKASQYVSLLIRDSQPSDSATYLCAVNDAGNMLTFGGGTRLMVKPNIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSS

SEQ ID NO: 466 - protein, 313 aa, Homo sapiens
MALLLLLLGPGISLLLPGSLAGSGLGAVVSQHPSWVICKSGTSVKIECRSLDFQATTMFWYRQFPKQSLMLMATSNEGSKATYEQGVEKDKFLINHASLTLSTLTVTSAHPEDSSFYICSAAGQANTEAFFGQGTRLTVVEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 467 - protein, 6 aa, Homo sapiens
DSASNY

SEQ ID NO: 468 - protein, 7 aa, Homo sapiens
IRSNVGE

SEQ ID NO: 469 - protein, 18 aa, Homo sapiens
CAASKSAIMVVLQTSSSL

SEQ ID NO: 470 - protein, 5 aa, Homo sapiens
MNHEY

SEQ ID NO: 471 - protein, 6 aa, Homo sapiens
SMNVEV

SEQ ID NO: 472 - protein, 14 aa, Homo sapiens
CASSIQQGADTQYF

SEQ ID NO: 473 - protein, 137 aa, Homo sapiens
MASIRAVFIFLWLQLDLVNGENVEQHPSTLSVQEGDSAVIKCTYSDSASNYFPWYKQELGKGPQLIIDIRSNVGEKKDQRIAVTLNKTAKHFSLHITETQPEDSAVYFCAASKSAIMVVLQTSSSLELALCLLSSQV

SEQ ID NO: 474 - protein, 132 aa, Homo sapiens
MHPQLLGYVVLCLLGAGPLEAQVTQNPRYLITVTGKKLTVTCSQNMNHEYMSWYRQDPGLGLRQIYYSMNVEVTDKGDVPEGYKVSRKEKRNFPLILESPSPNQTSLYFCASSIQQGADTQYFGPGTRLTVL

SEQ ID NO: 475 - protein, 274 aa, Homo sapiens
MASIRAVFIFLWLQLDLVNGENVEQHPSTLSVQEGDSAVIKCTYSDSASNYFPWYKQELGKGPQLIIDIRSNVGEKKDQRIAVTLNKTAKHFSLHITETQPEDSAVYFCAASKSAIMVVLQTSSSLELALCLLSSQVNIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSS

SEQ ID NO: 476 - protein, 305 aa, Homo sapiens
MHPQLLGYVVLCLLGAGPLEAQVTQNPRYLITVTGKKLTVTCSQNMNHEYMSWYRQDPGLGLRQIYYSMNVEVTDKGDVPEGYKVSRKEKRNFPLILESPSPNQTSLYFCASSIQQGADTQYFGPGTRLTVLEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 477 - protein, 6 aa, Homo sapiens
DRGSQS

SEQ ID NO: 478 - protein, 6 aa, Homo sapiens
IYSNGD

SEQ ID NO: 479 - protein, 14 aa, Homo sapiens
CAWNSGGSNYKLTF

SEQ ID NO: 480 - protein, 5 aa, Homo sapiens
MNHEY

SEQ ID NO: 481 - protein, 6 aa, Homo sapiens
SVGEGT

SEQ ID NO: 482 - protein, 15 aa, Homo sapiens
CASSYSQAWGQPQHF

SEQ ID NO: 483 - protein, 133 aa, Homo sapiens
MASLRVLLVILWLQLSWVWSQQKEVEQNSGPLSVPEGAIASLNCTYSDRGSQSFFWYRQYSGKSPELIMFIYSNGDKEDGRFTAQLNKASQYVSLLIRDSQPSDSATYLCAWNSGGSNYKLTFGKGTLLTVNP

SEQ ID NO: 484 - protein, 133 aa, Homo sapiens
MHLGLLCCGAFSLLWAGPVNAGVTQTPKFRVLKTGQSMTLLCAQDMNHEYMYWYRQDPGMGLRLIHYSVGEGTTAKGEVPDGYNVSRLKKQNFLLGLESAAPSQTSVYFCASSYSQAWGQPQHFGDGTRLSIL

SEQ ID NO: 485 - protein, 270 aa, Homo sapiens
MASLRVLLVILWLQLSWVWSQQKEVEQNSGPLSVPEGAIASLNCTYSDRGSQSFFWYRQYSGKSPELIMFIYSNGDKEDGRFTAQLNKASQYVSLLIRDSQPSDSATYLCAWNSGGSNYKLTFGKGTLLTVNPNIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSS

SEQ ID NO: 486 - protein, 306 aa, Homo sapiens
MHLGLLCCGAFSLLWAGPVNAGVTQTPKFRVLKTGQSMTLLCAQDMNHEYMYWYRQDPGMGLRLIHYSVGEGTTAKGEVPDGYNVSRLKKQNFLLGLESAAPSQTSVYFCASSYSQAWGQPQHFGDGTRLSILEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 487 - protein, 6 aa, Homo sapiens
SSNFYA

SEQ ID NO: 488 - protein, 7 aa, Homo sapiens
MTLNGDE

SEQ ID NO: 489 - protein, 13 aa, Homo sapiens
CALITGGGNKLTF

SEQ ID NO: 490 - protein, 5 aa, Homo sapiens
MNHEY

SEQ ID NO: 491 - protein, 6 aa, Homo sapiens
SVGEGT

SEQ ID NO: 492 - protein, 14 aa, Homo sapiens
CASRLQGWNSPLHF

SEQ ID NO: 493 - protein, 134 aa, Homo sapiens
MAKNPLAAPLLILWFHLDCVSSILNVEQSPQSLHVQEGDSTNFTCSFPSSNFYALHWYRWETAKSPEALFVMTLNGDEKKKGRISATLNTKEGYSYLYIKGSQPEDSATYLCALITGGGNKLTFGTGTQLKVEL

SEQ ID NO: 494 - protein, 132 aa, Homo sapiens
MHLGLLCCGAFSLLWAGPVNAGVTQTPKFRVLKTGQSMTLLCAQDMNHEYMYWYRQDPGMGLRLIHYSVGEGTTAKGEVPDGYNVSRLKKQNFLLGLESAAPSQTSVYFCASRLQGWNSPLHFGNGTRLTVT

SEQ ID NO: 495 - protein, 271 aa, Homo sapiens
MAKNPLAAPLLILWFHLDCVSSILNVEQSPQSLHVQEGDSTNFTCSFPSSNFYALHWYRWETAKSPEALFVMTLNGDEKKKGRISATLNTKEGYSYLYIKGSQPEDSATYLCALITGGGNKLTFGTGTQLKVELNIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSS

SEQ ID NO: 496 - protein, 305 aa, Homo sapiens
MHLGLLCCGAFSLLWAGPVNAGVTQTPKFRVLKTGQSMTLLCAQDMNHEYMYWYRQDPGMGLRLIHYSVGEGTTAKGEVPDGYNVSRLKKQNFLLGLESAAPSQTSVYFCASRLQGWNSPLHFGNGTRLTVTEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 497 - protein, 15 aa, Homo sapiens
HYNYMCNSSCMGSMN

SEQ ID NO: 498 - protein, 15 aa, Homo sapiens
YNYMCNSSCMGSMNR

SEQ ID NO: 499 - protein, 15 aa, Homo sapiens
NYMCNSSCMGSMNRR

SEQ ID NO: 500 - protein, 15 aa, Homo sapiens
YMCNSSCMGSMNRRP

SEQ ID NO: 501 - protein, 15 aa, Homo sapiens
MCNSSCMGSMNRRPI

SEQ ID NO: 502 - protein, 15 aa, Homo sapiens
CNSSCMGSMNRRPIL

SEQ ID NO: 503 - protein, 15 aa, Homo sapiens
NSSCMGSMNRRPILT

SEQ ID NO: 504 - protein, 15 aa, Homo sapiens
SSCMGSMNRRPILTI

SEQ ID NO: 505 - protein, 15 aa, Homo sapiens
SCMGSMNRRPILTII

SEQ ID NO: 506 - protein, 15 aa, Homo sapiens
CMGSMNRRPILTIIT

SEQ ID NO: 507 - protein, 15 aa, Homo sapiens
MGSMNRRPILTIITL

SEQ ID NO: 508 - protein, 15 aa, Homo sapiens
DRNTFRHSVVVPCEP

SEQ ID NO: 509 - protein, 15 aa, Homo sapiens
RNTFRHSVVVPCEPP

SEQ ID NO: 510 - protein, 15 aa, Homo sapiens
NTFRHSVVVPCEPPE

SEQ ID NO: 511 - protein, 15 aa, Homo sapiens
TFRHSVVVPCEPPEV

SEQ ID NO: 512 - protein, 15 aa, Homo sapiens
FRHSVVVPCEPPEVG

SEQ ID NO: 513 - protein, 15 aa, Homo sapiens
RHSVVVPCEPPEVGS

SEQ ID NO: 514 - protein, 15 aa, Homo sapiens
HSVVVPCEPPEVGSD

SEQ ID NO: 515 - protein, 15 aa, Homo sapiens
SVVVPCEPPEVGSDC

SEQ ID NO: 516 - protein, 15 aa, Homo sapiens
VVVPCEPPEVGSDCT

SEQ ID NO: 517 - protein, 15 aa, Homo sapiens
VVPCEPPEVGSDCTT

SEQ ID NO: 518 - protein, 15 aa, Homo sapiens
VPCEPPEVGSDCTTI

SEQ ID NO: 519 - protein, 15 aa, Homo sapiens
YKQSQHMTEVVRHCP

SEQ ID NO: 520 - protein, 15 aa, Homo sapiens
KQSQHMTEVVRHCPH

SEQ ID NO: 521 - protein, 15 aa, Homo sapiens
QSQHMTEVVRHCPHH

SEQ ID NO: 522 - protein, 15 aa, Homo sapiens
SQHMTEVVRHCPHHE

SEQ ID NO: 523 - protein, 15 aa, Homo sapiens
QHMTEVVRHCPHHER

SEQ ID NO: 524 - protein, 15 aa, Homo sapiens
HMTEVVRHCPHHERC

SEQ ID NO: 525 - protein, 15 aa, Homo sapiens
MTEVVRHCPHHERCS

SEQ ID NO: 526 - protein, 15 aa, Homo sapiens
TEVVRHCPHHERCSD

SEQ ID NO: 527 - protein, 15 aa, Homo sapiens
EVVRHCPHHERCSDS

SEQ ID NO: 528 - protein, 15 aa, Homo sapiens
VVRHCPHHERCSDSD

SEQ ID NO: 529 - protein, 15 aa, Homo sapiens
VRHCPHHERCSDSDG

SEQ ID NO: 530 - protein, 9 aa, Homo sapiens
HMTEVVRHC

SEQ ID NO: 531 - protein, 10 aa, Homo sapiens
SQHMTEVVRH

SEQ ID NO: 532 - protein, 9 aa, Homo sapiens
HMTEVVRRC

SEQ ID NO: 533 - protein, 13 aa, Homo sapiens
RNTFRHSVVVPYE

SEQ ID NO: 534 - protein, 13 aa, Homo sapiens
RNTFRHSVVVPCE

SEQ ID NO: 535 - protein, 341 aa, Homo sapiens
MEEPQSDPSVEPPLSQETFSDLWKLLPENNVLSPLPSQAMDDLMLSPDDIEQWFTEDPGPDEAPRMPEAAPPVAPAPAAPTPAAPAPAPSWPLSSSVPSQKTYQGSYGFRLGFLHSGTAKSVTCTYSPALNKMFCQLAKTCPVQLWVDSTPPPGTRVRAMAIYKQSQHMTEVVRRCPHHERCSDSDGLAPPQHLIRVEGNLRVEYLDDRNTFRHSVVVPYEPPEVGSDCTTIHYNYMCNSSCMGGMNRRPILTIITLEDSSGNLLGRNSFEVRVCACPGRDRRTEEENLRKKGEPHHELPPGSTKRALPNNTSSSPQPKKKPLDGEYFTLQDQTSFQKENC

SEQ ID NO: 536 - protein, 346 aa, Homo sapiens
MEEPQSDPSVEPPLSQETFSDLWKLLPENNVLSPLPSQAMDDLMLSPDDIEQWFTEDPGPDEAPRMPEAAPPVAPAPAAPTPAAPAPAPSWPLSSSVPSQKTYQGSYGFRLGFLHSGTAKSVTCTYSPALNKMFCQLAKTCPVQLWVDSTPPPGTRVRAMAIYKQSQHMTEVVRRCPHHERCSDSDGLAPPQHLIRVEGNLRVEYLDDRNTFRHSVVVPYEPPEVGSDCTTIHYNYMCNSSCMGGMNRRPILTIITLEDSSGNLLGRNSFEVRVCACPGRDRRTEEENLRKKGEPHHELPPGSTKRALPNNTSSSPQPKKKPLDGEYFTLQMLLDLRWCYFLINSS

SEQ ID NO: 537 - protein, 354 aa, Homo sapiens
MDDLMLSPDDIEQWFTEDPGPDEAPRMPEAAPPVAPAPAAPTPAAPAPAPSWPLSSSVPSQKTYQGSYGFRLGFLHSGTAKSVTCTYSPALNKMFCQLAKTCPVQLWVDSTPPPGTRVRAMAIYKQSQHMTEVVRRCPHHERCSDSDGLAPPQHLIRVEGNLRVEYLDDRNTFRHSVVVPYEPPEVGSDCTTIHYNYMCNSSCMGGMNRRPILTIITLEDSSGNLLGRNSFEVRVCACPGRDRRTEEENLRKKGEPHHELPPGSTKRALPNNTSSSPQPKKKPLDGEYFTLQIRGRERFEMFRELNEALELKDAQAGKEPGGSRAHSSHLKSKKGQSTSRHKKLMFKTEGPDSD

SEQ ID NO: 538 - protein, 302 aa, Homo sapiens
MDDLMLSPDDIEQWFTEDPGPDEAPRMPEAAPPVAPAPAAPTPAAPAPAPSWPLSSSVPSQKTYQGSYGFRLGFLHSGTAKSVTCTYSPALNKMFCQLAKTCPVQLWVDSTPPPGTRVRAMAIYKQSQHMTEVVRRCPHHERCSDSDGLAPPQHLIRVEGNLRVEYLDDRNTFRHSVVVPYEPPEVGSDCTTIHYNYMCNSSCMGGMNRRPILTIITLEDSSGNLLGRNSFEVRVCACPGRDRRTEEENLRKKGEPHHELPPGSTKRALPNNTSSSPQPKKKPLDGEYFTLQDQTSFQKENC

SEQ ID NO: 539 - protein, 307 aa, Homo sapiens
MDDLMLSPDDIEQWFTEDPGPDEAPRMPEAAPPVAPAPAAPTPAAPAPAPSWPLSSSVPSQKTYQGSYGFRLGFLHSGTAKSVTCTYSPALNKMFCQLAKTCPVQLWVDSTPPPGTRVRAMAIYKQSQHMTEVVRRCPHHERCSDSDGLAPPQHLIRVEGNLRVEYLDDRNTFRHSVVVPYEPPEVGSDCTTIHYNYMCNSSCMGGMNRRPILTIITLEDSSGNLLGRNSFEVRVCACPGRDRRTEEENLRKKGEPHHELPPGSTKRALPNNTSSSPQPKKKPLDGEYFTLQMLLDLRWCYFLINSS

SEQ ID NO: 540 - protein, 261 aa, Homo sapiens
MFCQLAKTCPVQLWVDSTPPPGTRVRAMAIYKQSQHMTEVVRRCPHHERCSDSDGLAPPQHLIRVEGNLRVEYLDDRNTFRHSVVVPYEPPEVGSDCTTIHYNYMCNSSCMGGMNRRPILTIITLEDSSGNLLGRNSFEVRVCACPGRDRRTEEENLRKKGEPHHELPPGSTKRALPNNTSSSPQPKKKPLDGEYFTLQIRGRERFEMFRELNEALELKDAQAGKEPGGSRAHSSHLKSKKGQSTSRHKKLMFKTEGPDSD

SEQ ID NO: 541 - protein, 209 aa, Homo sapiens
MFCQLAKTCPVQLWVDSTPPPGTRVRAMAIYKQSQHMTEVVRRCPHHERCSDSDGLAPPQHLIRVEGNLRVEYLDDRNTFRHSVVVPYEPPEVGSDCTTIHYNYMCNSSCMGGMNRRPILTIITLEDSSGNLLGRNSFEVRVCACPGRDRRTEEENLRKKGEPHHELPPGSTKRALPNNTSSSPQPKKKPLDGEYFTLQDQTSFQKENC

SEQ ID NO: 542 - protein, 214 aa, Homo sapiens
MFCQLAKTCPVQLWVDSTPPPGTRVRAMAIYKQSQHMTEVVRRCPHHERCSDSDGLAPPQHLIRVEGNLRVEYLDDRNTFRHSVVVPYEPPEVGSDCTTIHYNYMCNSSCMGGMNRRPILTIITLEDSSGNLLGRNSFEVRVCACPGRDRRTEEENLRKKGEPHHELPPGSTKRALPNNTSSSPQPKKKPLDGEYFTLQMLLDLRWCYFLINSS

SEQ ID NO: 543 - protein, 598 aa, Artificial Sequence
  Synthetic
MATRLLCWAALCLLGAELTEAGVAQSPRYKIIEKRQSVAFWCNPISGHATLYWYQQILGQGPKLLIQFQNNGVVDDSQLPKDRFSAERLKGVDSTLKIQPAKLEDSAVYLCASSLVNTEAFFGQGTRLTVVEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNSRAKRSGSGATNFSLLKQAGDVEENPGPMLLLLIPVLGMIFALRDARAQSVSQHNHHVILSEAASLELGCNYSYGGTVNLFWYVQYPGQHLQLLLKYFSGDPLVKGIKGFEAEFIKSKFSFNLRKPSVQWSDTAEYFCAVKGDYKLSFGAGTTVTVRANIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSS

SEQ ID NO: 544 - protein, 604 aa, Artificial Sequence
  Synthetic
MAPGLLHWMALCLLGTGHGDAMVIQNPRYQVTQFGKPVTLSCSQTLNHNVMYWYQQKSSQAPKLLFHYYDKDFNNEADTPDNFQSRRPNTSFCFLDIRSPGLGDAAMYLCATSRELRGNEQFFGPGTRLTVLEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNSRAKRSGSGATNFSLLKQAGDVEENPGPMLTASLLRAVIASICVVSSMAQKVTQAQTEISVVEKEDVTLDCVYETRDTTYYLFWYKQPPSGELVFLIRRNSFDEQNEISGRYSWNFQKSTSSFNFTITASQVVDSAVYFCALSEGGSNYKLTFGKGTLLTVNPNIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSS

SEQ ID NO: 545 - protein, 598 aa, Artificial Sequence
  Synthetic
MAMSIGLLCCAALSLLWAGPVNAGVTQTPKFQVLKTGQSMTLQCAQDMNHEYMSWYRQDPGMGLRLIHYSVGAGITDQGEVPNGYNVSRSTTEDFPLRLLSAAPSQTSVYFCASSYRESHYGYTFGSGTRLTVVEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNSRAKRSGSGATNFSLLKQAGDVEENPGPMWGVFLLYVSMKMGGTTGQNIDQPTEMTATEGAIVQINCTYQTSGFNGLFWYQQHAGEAPTFLSYNVLDGLEEKGRFSSFLSRSKGYSYLLLKELQMKDSASYLCAVKWTGGFKTIFGAGTRLFVKANIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSS

SEQ ID NO: 546 - protein, 608 aa, Artificial Sequence
  Synthetic
MALLLLLLGPGISLLLPGSLAGSGLGAVVSQHPSWVICKSGTSVKIECRSLDFQATTMFWYRQFPKQSLMLMATSNEGSKATYEQGVEKDKFLINHASLTLSTLTVTSAHPEDSSFYICSAAGQANTEAFFGQGTRLTVVEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNSRAKRSGSGATNFSLLKQAGDVEENPGPMHSLRVLLVILWLQLSWVWSQQKEVEQNSGPLSVPEGAIASLNCTYSDRGSQSFFWYRQYSGKSPELIMFIYSNGDKEDGRFTAQLNKASQYVSLLIRDSQPSDSATYLCAVNDAGNMLTFGGGTRLMVKPNIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSS

SEQ ID NO: 547 - protein, 602 aa, Artificial Sequence
  Synthetic
MAIGLLCCVAFSLLWASPVNAGVTQTPKFQVLKTGQSMTLQCAQDMNHNSMYWYRQDPGMGLRLIYYSASEGTTDKGEVPNGYNVSRLNKREFSLRLESAAPSQTSVYFCASSEGLWQVGDEQYFGPGTRLTVTEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNSRAKRSGSGATNFSLLKQAGDVEENPGPMISLRVLLVILWLQLSWVWSQRKEVEQDPGPFNVPEGATVAFNCTYSNSASQSFFWYRQDCRKEPKLLMSVYSSGNEDGRFTAQLNRASQYISLLIRDSKLSDSATYLCVVQPGGYQKVTFGTGTKLQVIPDIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSS

SEQ ID NO: 548 - protein, 607 aa, Artificial Sequence
  Synthetic
MATRLFFYVALCLLWTGHMDAGITQSPRHKVTETGTPVTLRCHQTENHRYMYWYRQDPGHGLRLIHYSYGVKDTDKGEVSDGYSVSRSKTEDFLLTLESATSSQTSVYFCAISELVTGDSPLHFGNGTRLTVTEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNSRAKRSGSGATNFSLLKQAGDVEENPGPMTRVSLLWAVVVSTCLESGMAQTVTQSQPEMSVQEAETVTLSCTYDTSENNYYLFWYKQPPSRQMILVIRQEAYKQQNATENRFSVNFQKAAKSFSLKISDSQLGDTAMYFCAFMGYSGAGSYQLTFGKGTKLSVIPDIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSS

SEQ ID NO: 549 - protein, 602 aa, Artificial Sequence
  Synthetic
MATRLLCWAALCLLGAELTEAGVAQSPRYKIIEKRQSVAFWCNPISGHATLYWYQQILGQGPKLLIQFQNNGVVDDSQLPKDRFSAERLKGVDSTLKIQPAKLEDSAVYLCASSLDPGDTGELFFGEGSRLTVLEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNSRAKRSGSGATNFSLLKQAGDVEENPGPMESFLGGVLLILWLQVDWVKSQKIEQNSEALNIQEGKTATLTCNYTNYSPAYLQWYRQDPGRGPVFLLLIRENEKEKRKERLKVTFDTTLKQSLFHITASQPADSATYLCALDIYPHDMRFGAGTRLTVKPDIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSS

SEQ ID NO: 550 - protein, 607 aa, Artificial Sequence
  Synthetic
MATASLLRAVIASICVVSSMAQKVTQAQTEISVVEKEDVTLDCVYETRDTTYYLFWYKQPPSGELVFLIRRNSFDEQNEISGRYSWNFQKSTSSFNFTITASQVVDSAVYFCALSEVDSGNTPLVFGKGTRLSVIANIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSSRAKRSGSGATNFSLLKQAGDVEENPGPMHFRLLCCVAFCLLGAGPVDSGVTQTPKHLITATGQRVTLRCSPRSGDLSVYWYQQSLDQGLQFLIQYYNGEERAKGNILERFSAQQFPDLHSELNLSSLELGDSALYFCASSVGSSSSTDTQYFGPGTRLTVLEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 551 - protein, 607 aa, Artificial Sequence
  Synthetic
MATASLLRAVIASICVVSSMAQKVTQAQTEISVVEKEDVTLDCVYETRDTTYYLFWYKQPPSGELVFLIRRNSFDEQNEISGRYSWNFQKSTSSFNFTITASQVVDSAVYFCALSEVDSGNTPLVFGKGTRLSVIANIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSSRAKRSGSGATNFSLLKQAGDVEENPGPMHFRLLCCVAFCLLGAGPVDSGVTQTPKHLITATGQRVTLRCSPRSGDLSVYWYQQSLDQGLQFLIHYYNGEERAKGNILERFSAQQFPDLHSELNLSSLELGDSALYFCASSVGSSSSTDTQYFGPGTRLTVLEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 552 - protein, 611 aa, Artificial Sequence
  Synthetic
MAKSLRVLLVILWLQLSWVWSQQKEVEQDPGPLSVPEGAIVSLNCTYSNSAFQYFMWYRQYSRKGPELLMYTYSSGNKEDGRFTAQVDKSSKYISLFIRDSQPSDSATYLCAMTSPYNNNDMRFGAGTRLTVKPNIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSSRAKRSGSGATNFSLLKQAGDVEENPGPMHLLLLLLGPGISLLLPGSLAGSGLGAVVSQHPSWVICKSGTSVKIECRSLDFQATTMFWYRQFPKQSLMLMATSNEGSKATYEQGVEKDKFLINHASLTLSTLTVTSAHPEDSSFYICSGGLEEAARQFIGPGTRLTVLEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 553 - protein, 601 aa, Artificial Sequence
  Synthetic
MAKSLRVLLVILWLQLSWVWSQQKEVEQDPGPLSVPEGAIVSLNCTYSNSAFQYFMWYRQYSRKGPELLMYTYSSGNKEDGRFTAQVDKSSKYISLFIRDSQPSDSATYLCAMTSPYNNNDMRFGAGTRLTVKPNIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSSRAKRSGSGATNFSLLKQAGDVEENPGPMHLLLLLLGPAGSGLGAVVSQHPSRVICKSGTSVKIECRSLDFQATTMFWYRQFPKQSLMLMATSNEGSKATYEQGVEKDKFLINHASLTLSTLTVTSAHPEDSSFYICSGGLEEAARQFIGPGTRLTVLEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 554 - protein, 596 aa, Artificial Sequence
  Synthetic
MALVARVTVFLTFGTIIDAKTTQPPSMDCAEGRAANLPCNHSTISGNEYVYWYRQIHSQGPQYIIHGLKNNETNEMASLIITEDRKSSTLILPHATLRDTAVYYCIVPNDYKLSFGAGTTVTVRANIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSSRAKRSGSGATNFSLLKQAGDVEENPGPMHIRLLCRVAFCFLAVGLVDVKVTQSSRYLVKRTGEKVFLECVQDMDHENMFWYRQDPGLGLRLIYFSYDVKMKEKGDIPEGYSVSREKKERFSLILESASTNQTSMYLCASSFGTGSIQETQYFGPGTRLLVLEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 555 - protein, 610 aa, Artificial Sequence
  Synthetic
MAYSPGLVSLILLLLGRTRGNSVTQMEGPVTLSEEAFLTINCTYTATGYPSLFWYVQYPGEGLQLLLKATKADDKGSNKGFEATYRKETTSFHLEKGSVQVSDSAVYFCALNPNAGGTSYGKLTFGQGTILTVHPNIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSSRAKRSGSGATNFSLLKQAGDVEENPGPMHPRLLFWALLCLLGTGPVEAGVTQSPTHLIKTRGQQATLRCSPISGHTSVYWYQQALGLGLQFLLWYDEGEERNRGNFPPRFSGRQFPNYSSELNVNALELEDSALYLCASSSPGATSGGANTGELFFGEGSRLTVLEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 556 - protein, 614 aa, Artificial Sequence
  Synthetic
MATFAGFSFLFLWLQLDCMSRGEDVEQSLFLSVREGDSSVINCTYTDSSSTYLYWYKQEPGAGLQLLTYIFSNMDMKQDQRLTVLLNKKDKHLSLRIADTQTGDSAIYFCAEIPRDSGGGADGLTFGKGTHLIIQPNIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSSRAKRSGSGATNFSLLKQAGDVEENPGPMHLLLLLLGPGISLLLPGSLAGSGLGAVVSQHPSWVICKSGTSVKIECRSLDFQATTMFWYRQFPKQSLMLMATSNEGSKATYEQGVEKDKFLINHASLTLSTLTVTSAHPEDSSFYICSARDLQRSYEQYFGPGTRLTVTEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 557 - protein, 604 aa, Artificial Sequence
  Synthetic
MATFAGFSFLFLWLQLDCMSRGEDVEQSLFLSVREGDSSVINCTYTDSSSTYLYWYKQEPGAGLQLLTYIFSNMDMKQDQRLTVLLNKKDKHLSLRIADTQTGDSAIYFCAEIPRDSGGGADGLTFGKGTHLIIQPNIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSSRAKRSGSGATNFSLLKQAGDVEENPGPMHLLLLLLGPAGSGLGAVVSQHPSRVICKSGTSVKIECRSLDFQATTMFWYRQFPKQSLMLMATSNEGSKATYEQGVEKDKFLINHASLTLSTLTVTSAHPEDSSFYICSARDLQRSYEQYFGPGTRLTVTEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 558 - protein, 606 aa, Artificial Sequence
  Synthetic
MAGIRALFMYLWLQLDWVSRGESVGLHLPTLSVQEGDNSIINCAYSNSASDYFIWYKQESGKGPQFIIDIRSNMDKRQGQRVTVLLNKTVKHLSLQIAATQPGDSAVYFCAEPVGGLNSGYALNFGKGTSLLVTPNIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSSRAKRSGSGATNFSLLKQAGDVEENPGPMHPGLLCWVLLCLLGAGPVDAGVTQSPTHLIKTRGQQVTLRCSPISGHKSVSWYQQVLGQGPQFIFQYYEKEERGRGNFPDRFSARQFPNYSSELNVNALLLGDSALYLCASSGGRTSGAYEQFFGPGTRLTVLEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 559 - protein, 604 aa, Artificial Sequence
  Synthetic
MAKMLECAFIVLWLQLGWLSGEDQVTQSPEALRLQEGESSSLNCSYTVSGLRGLFWYRQDPGKGPEFLFTLYSAGEEKEKERLKATLTKKESFLHITAPKPEDSATYLCAVTAHRGSTLGRLYFGRGTQLTVWPNIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSSRAKRSGSGATNFSLLKQAGDVEENPGPMHPGLLCWALLCLLGAGLVDAGVTQSPTHLIKTRGQQVTLRCSPKSGHDTVSWYQQALGQGPQFIFQYYEEEERQRGNFPDRFSGHQFPNYSSELNVNALLLGDSALYLCASSRRGGAYNEQFFGPGTRLTVLEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 560 - protein, 605 aa, Artificial Sequence
  Synthetic
MAKNPLAAPLLILWFHLDCVSSILNVEQSPQSLHVQEGDSTNFTCSFPSSNFYALHWYRWETAKSPEALFVMTLNGDEKKKGRISATLNTKEGYSYLYIKGSQPEDSATYLCASVGGGADGLTFGKGTHLIIQPNIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSSRAKRSGSGATNFSLLKQAGDVEENPGPMHTRLLFWVAFCLLGADHTGAGVSQSPSNKVTEKGKDVELRCDPISGHTALYWYRQSLGQGLEFLIYFQGNSAPDKSGLPSDRFSAERTGGSVSTLTIQRTQQEDSAVYLCASTWDRGSYNEQFFGPGTRLTVLEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 561 - protein, 602 aa, Artificial Sequence
  Synthetic
MAKCPQALLAIFWLLLSWVSSEDKVVQSPLSLVVHEGDTVTLNCSYEVTNFRSLLWYKQEKKAPTFLFMLTSSGIEKKSGRLSSILDKKELSSILNITATQTGDSAIYLCAGQNYGGSQGNLIFGKGTKLSVKPNIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSSRAKRSGSGATNFSLLKQAGDVEENPGPMHTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCASRDPAYEQYFGPGTRLTVTEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 562 - protein, 606 aa, Artificial Sequence
  Synthetic
MASLRVLLVILWLQLSWVWSQQKEVEQNSGPLSVPEGAIASLNCTYSDRGSQSFFWYRQYSGKSPELIMFIYSNGDKEDGRFTAQLNKASQYVSLLIRDSQPSDSATYLCAVNPPVKTSYDKVIFGPGTSLSVIPNIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSSRAKRSGSGATNFSLLKQAGDVEENPGPMHTSLLCWVVLGFLGTDHTGAGVSQSPRYKVTKRGQDVALRCDPISGHVSLYWYRQALGQGPEFLTYFNYEAQQDKSGLPNDRFSAERPEGSISTLTIQRTEQRDSAMYRCASSHREPHTGELFFGEGSRLTVLEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 563 - protein, 600 aa, Artificial Sequence
  Synthetic
MASLRVLLVILWLQLSWVWSQQKEVEQNSGPLSVPEGAIASLNCTYSDRGSQSFFWYRQYSGKSPELIMFIYSNGDKEDGRFTAQLNKASQYVSLLIRDSQPSDSATYLCAVTLCGGYNKLIFGAGTRLAVHPNIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSSRAKRSGSGATNFSLLKQAGDVEENPGPMHNQVLCCVVLCFLGANTVDGGITQSPKYLFRKEGQNVTLSCEQNLNHDAMYWYRQDPGQGLRLIYYSQIVNDFQKGDIVEGYSVSREKKESFPLTVTSAQKNPTAFYLCASSSRDYEQYFGPGTRLTVTEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 564 - protein, 600 aa, Artificial Sequence
  Synthetic
MASLRVLLVILWLQLSWVWSQQKEVEQNSGPLSVPEGAIASLNCTYSDRGSQSFFWYRQYSGKSPELIMFIYSNGDKEDGRFTAQLNKASQYVSLLIRDSQPSDSATYLCAVTLSGGYNKLIFGAGTRLAVHPNIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSSRAKRSGSGATNFSLLKQAGDVEENPGPMHNQVLCCVVLCFLGANTVDGGITQSPKYLFRKEGQNVTLSCEQNLNHDAMYWYRQDPGQGLRLIYYSQIVNDFQKGDIVEGYSVSREKKESFPLTVTSAQKNPTAFYLCASSSRDYEQYFGPGTRLTVTEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 565 - protein, 600 aa, Artificial Sequence
  Synthetic
MASAPISMLAMLFTLSGLRAQSVAQPEDQVNVAEGNPLTVKCTYSVSGNPYLFWYVQYPNRGLQFLLKYITGDNLVKGSYGFEAEFNKSQTSFHLKKPSALVSDSALYFCAVRVWDYKLSFGAGTTVTVRANIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSSRAKRSGSGATNFSLLKQAGDVEENPGPMHNQVLCCVVLCFLGANTVDGGITQSPKYLFRKEGQNVTLSCEQNLNHDAMYWYRQDPGQGLRLIYYSQIVNDFQKGDIAEGYSVSREKKESFPLTVTSAQKNPTAFYLCASSISAGGDGYTFGSGTRLTVVEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 566 - protein, 608 aa, Artificial Sequence
  Synthetic
MAMLLGASVLILWLQPDWVNSQQKNDDQQVKQNSPSLSVQEGRISILNCDYTNSMFDYFLWYKKYPAEGPTFLISISSIKDKNEDGRFTVFLNKSAKHLSLHIVPSQPGDSAVYFCAANTGNQFYFGTGTSLTVIPNIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSSRAKRSGSGATNFSLLKQAGDVEENPGPMHTRLLCWAALCLLGAELTEAGVAQSPRYKIIEKRQSVAFWCNPISGHATLYWYQQILGQGPKLLIQFQNNGVVDDSQLPKDRFSAERLKGVDSTLKIQPAKLEDSAVYLCASSHLAGEFYNEQFFGPGTRLTVLEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 567 - protein, 595 aa, Artificial Sequence
  Synthetic
MAGAFLLYVSMKMGGTAGQSLEQPSEVTAVEGAIVQINCTYQTSGFYGLSWYQQHDGGAPTFLSYNALDGLEETGRFSSFLSRSDSYGYLLLQELQMKDSASYFCAFAYGQNFVFGPGTRLSVLPNIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSSRAKRSGSGATNFSLLKQAGDVEENPGPMHFRLLCCVAFCLLGAGPVDSGVTQTPKHLITATGQRVTLRCSPRSGDLSVYWYQQSLDQGLQFLIQYYNGEERAKGNILERFSAQQFPDLHSELNLSSLELGDSALYFCASSPLGDSGNTIYFGEGSWLTVVEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 568 - protein, 599 aa, Artificial Sequence
  Synthetic
MATLLGVSLVILWLQLARVNSQQGEEDPQALSIQEGENATMNCSYKTSINNLQWYRQNSGRGLVHLILIRSNEREKHSGRLRVTLDTSKKSSSLLITASRAADTASYFCATDAWNNDMRFGAGTRLTVKPNIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSSRAKRSGSGATNFSLLKQAGDVEENPGPMHIGLLCCVAFSLLWASPVNAGVTQTPKFQVLKTGQSMTLQCAQDMNHNSMYWYRQDPGMGLRLIYYSASEGTTDKGEVPNGYNVSRLNKREFSLRLESAAPSQTSVYFCASSESQGNTEAFFGQGTRLTVVEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 569 - protein, 601 aa, Artificial Sequence
  Synthetic
MAKHLTTFLVILWLYFYRGNGKNQVEQSPQSLIILEGKNCTLQCNYTVSPFSNLRWYKQDTGRGPVSLTIMTFSENTKSNGRYTATLDADTKQSSLHITASQLSDSASYICVVSSYKIIFGTGTRLHVFPNIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSSRAKRSGSGATNFSLLKQAGDVEENPGPMHTRLLFWVAFCLLGAYHTGAGVSQSPSNKVTEKGKDVELRCDPISGHTALYWYRQRLGQGLEFLIYFQGNSAPDKSGLPSDRFSAERTGESVSTLTIQRTQQEDSAVYLCASSPIQGENSPLHFGNGTRLTVTEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 570 - protein, 601 aa, Artificial Sequence
  Synthetic
MAKHLTTFLVILWLYFYRGNGKNQVEQSPQSLIILEGKNCTLQCNYTVSPFSNLRWYKQDTGRGPVSLTIMTFSENTKSNGRYTATLDADTKQSSLHITASQLSDSASYICVVSSYKLIFGTGTRLQVFPNIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSSRAKRSGSGATNFSLLKQAGDVEENPGPMHTRLLFWVAFCLLGAYHTGAGVSQSPSNKVTEKGKDVELRCDPISGHTALYWYRQRLGQGLEFLIYFQGNSAPDKSGLPSDRFSAERTGESVSTLTIQRTQQEDSAVYLCASSPIQGENSPLHFGNGTRLTVTEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 571 - protein, 595 aa, Artificial Sequence
  Synthetic
MALLLVPAFQVIFTLGGTRAQSVTQLDSQVPVFEEAPVELRCNYSSSVSVYLFWYVQYPNQGLQLLLKYLSGSTLVESINGFEAEFNKSQTSFHLRKPSVHISDTAEYFCAVSKGTGAQKLVFGQGTRLTINPNIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSSRAKRSGSGATNFSLLKQAGDVEENPGPMHNQVLCCVVLCFLGANTVDGGITQSPKYLFRKEGQNVTLSCEQNLNHDAMYWYRQDPGQGLRLIYYSQIVNDFQKGDIAEGYSVSREKKESFPLIVTSAQKNPTASYLCASEAFFGQGTRLTVVEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 572 - protein, 597 aa, Artificial Sequence
  Synthetic
MALVTSITVLLSLGIMGDAKTTQPNSMESNEEEPVHLPCNHSTISGTDYIHWYRQLPSQGPEYVIHGLTSNVNNRMASLAIAEDRKSSTLILHRATLRDAAVYYCILASGAGSYQLTFGKGTKLSVIPNIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSSRAKRSGSGATNFSLLKQAGDVEENPGPMHCRLLCCVVFCLLQAGPLDTAVSQTPKYLVTQMGNDKSIKCEQNLGHDTMYWYKQDSKKFLKIMFSYNNKELIINETVPNRFSPKSPDKAHLNLHINSLELGDSAVYFCASRTIGYNTEAFFGQGTRLTVVEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 573 - protein, 602 aa, Artificial Sequence
  Synthetic
MAKIRQFLLAILWLQLSCVSAAKNEVEQSPQNLTAQEGEFITINCSYSVGISALHWLQQHPGGGIVSLFMLSSGKKKHGRLIATINIQEKHSSLHITASHPRDSAVYICAALSYNTDKLIFGTGTRLQVFPNIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSSRAKRSGSGATNFSLLKQAGDVEENPGPMHTRLLCWAALCLLGADHTGAGVSQTPSNKVTEKGKYVELRCDPISGHTALYWYRQSLGQGPEFLIYFQGTGAADDSGLPNDRFFAVRPEGSVSTLKIQRTERGDSAVYLCASSLSGLLQETQYFGPGTRLLVLEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 574 - protein, 605 aa, Artificial Sequence
  Synthetic
MAYSPGLVSLILLLLGRTRGNSVTQMEGPVTLSEEAFLTINCTYTATGYPSLFWYVQYPGEGLQLLLKATKADDKGSNKGFEATYRKETTSFHLEKGSVQVSDSAVYFCALSHTGSSNTGKLIFGQGTRLQVKPNIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSSRAKRSGSGATNFSLLKQAGDVEENPGPMHTRLLCWAALCLLGAELTEAGVAQSPRYKIIEKRQSVAFWCNPISGHATLYWYQQILGQGPKLLIQFQNNGVVDDSQLPKDRFSAERLKGVDSTLKIQPAKLEDSAVYLCASSTGGGRHQPQHFGDGTRLSILEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 575 - protein, 605 aa, Artificial Sequence
  Synthetic
MAYSPGLVSLILLLLGRTRGNSVTQMEGPVTLSEEAFLTINCTYTATGYPSLFWYVQYPGEGLQLLLKATKADDKGSNKGFEATYRKETTSFHLEKGSVQVSDSAVYFCALSQTGSSKTGKLIFGQGTRLQVKPNIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSSRAKRSGSGATNFSLLKQAGDVEENPGPMHTRLLCWAALCLLGAELTEAGVAQSPRYKIIEKRQSVAFWCNPISGHATLYWYQQILGQGPKLLIQFQNNGVVDDSQLPKDRFSAERLKGVDSTLKIQPAKLEDSAVYLCASSTGGGRHQPQHFGDGTRLSILEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 576 - protein, 605 aa, Artificial Sequence
  Synthetic
MAYSPGLVSLILLLLGRTRGNSVTQMEGPVTLSEEAFLTINCTYTATGYPSLFWYVQYPGEGLQLLLKATKADDKGSNKGFEATYRKETTSFHLEKGSVQVSDSAVYFCALSQTGSSNTGKLIFGQGTRLQVKPNIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSSRAKRSGSGATNFSLLKQAGDVEENPGPMHTRLLCWAALCLLGAELTEAGVAQSPRYKIIEKRQSVAFWCNPISGHATLYWYQQILGQGPKLLIQFQNNGVVDDSQLPKDRFSAERLKGVDSTLKIQPAKLEDSAVYLCASSTGGGRHQPQHFGDGTRLSILEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 577 - protein, 605 aa, Artificial Sequence
  Synthetic
MAYSPGLVSLILLLLGRTRGNSVTQMEGPVTLSEEAFLTINCTYTATGYPSLFWYVQYPGEGLQLLLKATKADDKGSNKGFEATYRKETTSFHLEKGSVQVSDSAVYFCALSTTGSSNTGKLIFGQGTTLQVKPNIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSSRAKRSGSGATNFSLLKQAGDVEENPGPMHTRLLCWAALCLLGAELTEAGVAQSPRYKIIEKRQSVAFWCNPISGHATLYWYQQILGQGPKLLIQFQNNGVVDDSQLPKDRFSAERLKGVDSTLKIQPAKLEDSAVYLCASSTGGGRHQPQHFGDGTRLSILEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 578 - protein, 598 aa, Artificial Sequence
  Synthetic
MASLRVLLVILWLQLSWVWSQQKEVEQNSGPLSVPEGAIASLNCTYSDRGSQSFFWYRQYSGKSPELIMFIYSNGDKEDGRFTAQLNKASQYVSLLIRDSQPSDSATYLCAVSWYSTLTFGKGTMLLVSPNIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSSRAKRSGSGATNFSLLKQAGDVEENPGPMHTRLFFYVALCLLWAGHRDAGITQSPRYKITETGRQVTLMCHQTWSHSYMFWYRQDLGHGLRLIYYSAAADITDKGEVPDGYVVSRSKTENFPLTLESATRSQTSVYFCASSGSRTDTQYFGPGTRLTVLEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 579 - protein, 597 aa, Artificial Sequence
  Synthetic
MALKFSVSILWIQLAWVSTQLLEQSPQFLSIQEGENLTVYCNSSSVFSSLQWYRQEPGEGPVLLVTVVTGGEVKKLKRLTFQFGDARKDSSLHITAAQPGDTGLYLCAGEFAGNQFYFGTGTSLTVIPNIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSSRAKRSGSGATNFSLLKQAGDVEENPGPMHCRLLCCAVLCLLGAVPIDTEVTQTPKHLVMGMTNKKSLKCEQHMGHRAMYWYKQKAKKPPELMFVYSYEKLSINESVPSRFSPECPNSSLLNLHLHALQPEDSALYLCASSQVGLTYEQYFGPGTRLTVTEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 580 - protein, 604 aa, Artificial Sequence
  Synthetic
MASAPISMLAMLFTLSGLRAQSVAQPEDQVNVAEGNPLTVKCTYSVSGNPYLFWYVQYPNRGLQFLLKYITGDNLVKGSYGFEAEFNKSQTSFHLKKPSALVSDSALYFCAVRDNSGGSNYKLTFGKGTLLTVNPNIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSSRAKRSGSGATNFSLLKQAGDVEENPGPMHTRLLCWAALCLLGAELTEAGVAQSPRYKIIEKRQSVAFWCNPISGHATLYWYQQILGQGPKLLIQFQNNGVVDDSQLPKDRFSAERLKGVDSTLKIQPAKLEDSAVYLCASSLGQGQTQYFGPGTRLLVLEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 581 - protein, 601 aa, Artificial Sequence
  Synthetic
MALLLVPAFQVIFTLGGTRAQSVTQLDSQVPVFEEAPVELRCNYSSSVSVYLFWYVQYPNQGLQLLLKYLSGSTLVESINGFEAEFNKSQTSFHLRKPSVHISDTAEYFCAVRGSSGTYKYIFGTGTRLKVLANIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSSRAKRSGSGATNFSLLKQAGDVEENPGPMHIRLLCRVAFCFLAVGLVDVKVTQSSRYLVKRTGEKVFLECVQDMDHENMFWYRQDPGLGLRLIYFSYDVKMKEKGDIPEGYSVSREKKERFSLILESASTNQTSMYLCASKGDQNTEAFFGQGTRLTVVEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 582 - protein, 598 aa, Artificial Sequence
  Synthetic
MAGVFLLYVSMKMGGTTGQNIDQPTEMTATEGAIVQINCTYQTSGFNGLFWYQQHAGEAPTFLSYNVLDGLEEKGRFSSFLSRSKGYSYLLLKELQMKDSASYLCAVRDLQTGANNLFFGTGTRLTVIPNIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSSRAKRSGSGATNFSLLKQAGDVEENPGPMHIRLLCRVAFCFLAVGLVDVKVTQSSRYLVKRTGEKVFLECVQDMDHENMFWYRQDPGLGLRLIYFSYDVKMKEKGDIPEGYSVSREKKERFSLILESASTNQTSMYLCASSLTFGTTEAFFGQGTRLTVVEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 583 - protein, 599 aa, Artificial Sequence
  Synthetic
MALLLVPAFQVIFTLGGTRAQSVTQLDSQVPVFEEAPVELRCNYSSSVSVYLFWYVQYPNQGLQLLLKYLSGSTLVESINGFEAEFNKSQTSFHLRKPSVHISDTAEYFCAVSDLVRDDKIIFGKGTRLHILPNIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSSRAKRSGSGATNFSLLKQAGDVEENPGPMHIGLLCCVAFSLLWASPVNAGVTQTPKFQVLKTGQSMTLQCAQDMNHNSMYWYRQDPGMGLRLIYYSASEGTTDKGEVPNGYNVSRLNKREFSLRLESAAPSQTSVYFCASIGGFEAFFGQGTRLTVVEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 584 - protein, 597 aa, Artificial Sequence
  Synthetic
MAGVFLLYVSMKMGGTTGQNIDQPTEMTATEGAIVQINCTYQTSGFNGLFWYQQHAGEAPTFLSYNVLDGLEEKGRFSSFLSRSKGYSYLLLKELQMKDSASYLCAVYTGGFKTIFGAGTRLFVKANIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSSRAKRSGSGATNFSLLKQAGDVEENPGPMHTRLLCWAALCLLGAELTEAGVAQSPRYKIIEKRQSVAFWCNPISGHATLYWYQQILGQGPKLLIQFQNNGVVDDSQLPKDRFSAERLKGVDSTLKIQPAKLEDSAVYLCASNLGGGSTDTQYFGPGTRLTVLEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 585 - protein, 599 aa, Artificial Sequence
  Synthetic
MAGVFLLYVSMKMGGTTGQNIDQPTEMTATEGAIVQINCTYQTSGFNGLFWYQQHAGEAPTFLSYNVLDGLEEKGRFSSFLSRSKGYSYLLLKELQMKDSASYLCAFYYGGSQGNLIFGKGTKLSVKPNIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSSRAKRSGSGATNFSLLKQAGDVEENPGPMHTRLLCWVVLGFLGTDHTGAGVSQSPRYKVAKRGQDVALRCDPISGHVSLFWYQQALGQGPEFLTYFQNEAQLDKSGLPSDRFFAERPEGSVSTLKIQRTQQEDSAVYLCASSFGSGSTDTQYFGPGTRLTVLEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 586 - protein, 599 aa, Artificial Sequence
  Synthetic
MAGVFLLYVSMKMGGTTGQNIDQPTEMTATEGAIVQINCTYQTSGFNGLFWYQQHAGEAPTFLSYNVLDGLEEKGRFSSFLSRSKGYSYLLLKELQMKDSASYLCAVYPGGSQGNLIFGKGTKLSVKPNIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSSRAKRSGSGATNFSLLKQAGDVEENPGPMHTRLLCWAALCLLGAELTEAGVAQSPRYKIIEKRQSVAFWCNPISGHATLYWYQQILGQGPKLLIQFQNNGVVDDSQLPKDRFSAERLKGVDSTLKIQPAKLEDSAVYLCASSLGTGSTDTQYFGPGTRLTVLEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 587 - protein, 606 aa, Artificial Sequence
  Synthetic
MASIRAVFIFLWLQLDLVNGENVEQHPSTLSVQEGDSAVIKCTYSDSASNYFPWYKQELGKGPQLIIDIRSNVGEKKDQRIAVTLNKTAKHFSLHITETQPEDSAVYFCAASKSAIMVVLQTSSSLELALCLLSSQVNIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSSRAKRSGSGATNFSLLKQAGDVEENPGPMHPQLLGYVVLCLLGAGPLEAQVTQNPRYLITVTGKKLTVTCSQNMNHEYMSWYRQDPGLGLRQIYYSMNVEVTDKGDVPEGYKVSRKEKRNFPLILESPSPNQTSLYFCASSIQQGADTQYFGPGTRLTVLEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 588 - protein, 603 aa, Artificial Sequence
  Synthetic
MASLRVLLVILWLQLSWVWSQQKEVEQNSGPLSVPEGAIASLNCTYSDRGSQSFFWYRQYSGKSPELIMFIYSNGDKEDGRFTAQLNKASQYVSLLIRDSQPSDSATYLCAWNSGGSNYKLTFGKGTLLTVNPNIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSSRAKRSGSGATNFSLLKQAGDVEENPGPMHLGLLCCGAFSLLWAGPVNAGVTQTPKFRVLKTGQSMTLLCAQDMNHEYMYWYRQDPGMGLRLIHYSVGEGTTAKGEVPDGYNVSRLKKQNFLLGLESAAPSQTSVYFCASSYSQAWGQPQHFGDGTRLSILEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 589 - protein, 603 aa, Artificial Sequence
  Synthetic
MAKNPLAAPLLILWFHLDCVSSILNVEQSPQSLHVQEGDSTNFTCSFPSSNFYALHWYRWETAKSPEALFVMTLNGDEKKKGRISATLNTKEGYSYLYIKGSQPEDSATYLCALITGGGNKLTFGTGTQLKVELNIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSSRAKRSGSGATNFSLLKQAGDVEENPGPMHLGLLCCGAFSLLWAGPVNAGVTQTPKFRVLKTGQSMTLLCAQDMNHEYMYWYRQDPGMGLRLIHYSVGEGTTAKGEVPDGYNVSRLKKQNFLLGLESAAPSQTSVYFCASRLQGWNSPLHFGNGTRLTVTEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 590 - protein, 10 aa, Homo sapiens
SSCMGGMNRR

SEQ ID NO: 591 - protein, 10 aa, Homo sapiens
SSCMGGMNWR

SEQ ID NO: 592 - protein, 15 aa, Homo sapiens
YMCNSSCMGGMNWRP

SEQ ID NO: 593 - protein, 15 aa, Homo sapiens
MCNSSCMGGMNWRPI

SEQ ID NO: 594 - protein, 15 aa, Homo sapiens
CNSSCMGGMNWRPIL

SEQ ID NO: 595 - protein, 15 aa, Homo sapiens
NSSCMGGMNWRPILT

SEQ ID NO: 596 - protein, 15 aa, Homo sapiens
SSCMGGMNWRPILTI

SEQ ID NO: 597 - protein, 15 aa, Homo sapiens
SCMGGMNWRPILTII

SEQ ID NO: 598 - protein, 15 aa, Homo sapiens
CMGGMNWRPILTIIT

SEQ ID NO: 599 - protein, 15 aa, Homo sapiens
MGGMNWRPILTIITL

SEQ ID NO: 600 - protein, 15 aa, Homo sapiens
GGMNWRPILTIITLE

SEQ ID NO: 601 - protein, 15 aa, Homo sapiens
GMNWRPILTIITLED

SEQ ID NO: 602 - protein, 15 aa, Homo sapiens
MNWRPILTIITLEDS

The invention claimed is:

1. An isolated or purified T cell receptor (TCR) having antigenic specificity for mutated human p53, wherein the mutated human p53 has one of the following human p53 mutations: R175H, Y220C, G245S, R248Q, or R248W, wherein the human p53 mutations are defined by reference to SEQ ID NO: 1, and wherein the TCR comprises an amino acid sequence at least 97% identical to SEQ ID NO: 23 or 24, an amino acid sequence at least 97% identical to SEQ ID NO: 25, and the amino acid sequences of:

(1) all of SEQ ID NOs: 27-32;
(2) all of SEQ ID NOs: 37-42;
(3) all of SEQ ID NOs: 47-52;
(4) all of SEQ ID NOs: 57-62;
(5) all of SEQ ID NOs: 67-72;
(6) all of SEQ ID NOs: 77-82;
(7) all of SEQ ID NOs: 87-92;
(8) all of SEQ ID NOs: 97-102;
(9) all of SEQ ID NOs: 107-112;
(10) all of SEQ ID NOs: 117-122;
(11) all of SEQ ID NOs: 127-132;
(12) all of SEQ ID NOs: 137-142;
(13) all of SEQ ID NOs: 147-152;
(14) all of SEQ ID NOs: 157-162;
(15) all of SEQ ID NOs: 167-172;
(16) all of SEQ ID NOs: 177-182;
(17) all of SEQ ID NOs: 187-192;
(18) all of SEQ ID NOs: 197-202;
(19) all of SEQ ID NOs: 207-212;
(20) all of SEQ ID NOs: 217-222;
(21) all of SEQ ID NOs: 227-232;
(22) all of SEQ ID NOs: 237-242;
(23) all of SEQ ID NOs: 247-252;
(24) all of SEQ ID NOs: 257-262;
(25) all of SEQ ID NOs: 267-272;
(26) all of SEQ ID NOs: 277-282;
(27) all of SEQ ID NOs: 287-292;
(28) all of SEQ ID NOs: 297-302;
(29) all of SEQ ID NOs: 307-312;
(30) all of SEQ ID NOs: 317-322;
(31) all of SEQ ID NOs: 327-332;
(32) all of SEQ ID NOs: 337-342;
(33) all of SEQ ID NOs: 347-352;
(34) all of SEQ ID NOs: 357-362;
(35) all of SEQ ID NOs: 367-372;
(36) all of SEQ ID NOs: 377-382;
(37) all of SEQ ID NOs: 387-392;
(38) all of SEQ ID NOs: 397-402;

(39) all of SEQ ID NOs: 407-412;
(40) all of SEQ ID NOs: 417-422;
(41) all of SEQ ID NOs: 427-432;
(42) all of SEQ ID NOs: 437-442;
(43) all of SEQ ID NOs: 447-452;
(44) all of SEQ ID NOs: 457-462;
(45) all of SEQ ID NOs: 477-482; or
(46) all of SEQ ID NOs: 487-492.

2. The TCR of claim 1, wherein the TCR comprises:
(1) an amino acid sequence at least 99% identical to SEQ ID NO: 33 and an amino acid sequence at least 99% identical to SEQ ID NO: 34;
(2) an amino acid sequence at least 99% identical to SEQ ID NO: 43 and an amino acid sequence at least 99% identical to SEQ ID NO: 44;
(3) an amino acid sequence at least 99% identical to SEQ ID NO: 53 and an amino acid sequence at least 99% identical to SEQ ID NO: 54;
(4) an amino acid sequence at least 99% identical to SEQ ID NO: 63 and an amino acid sequence at least 99% identical to SEQ ID NO: 64;
(5) an amino acid sequence at least 99% identical to SEQ ID NO: 73 and an amino acid sequence at least 99% identical to SEQ ID NO: 74;
(6) an amino acid sequence at least 99% identical to SEQ ID NO: 83 and an amino acid sequence at least 99% identical to SEQ ID NO: 84;
(7) an amino acid sequence at least 99% identical to SEQ ID NO: 93 and an amino acid sequence at least 99% identical to SEQ ID NO: 94;
(8) an amino acid sequence at least 99% identical to SEQ ID NO: 103 and an amino acid sequence at least 99% identical to SEQ ID NO: 104;
(9) an amino acid sequence at least 99% identical to SEQ ID NO: 113 and an amino acid sequence at least 99% identical to SEQ ID NO: 114;
(10) an amino acid sequence at least 99% identical to SEQ ID NO: 123 and an amino acid sequence at least 99% identical to SEQ ID NO: 124;
(11) an amino acid sequence at least 99% identical to SEQ ID NO: 133 and an amino acid sequence at least 99% identical to SEQ ID NO: 134;
(12) an amino acid sequence at least 99% identical to SEQ ID NO: 143 and an amino acid sequence at least 99% identical to SEQ ID NO: 144;
(13) an amino acid sequence at least 99% identical to SEQ ID NO: 153 and an amino acid sequence at least 99% identical to SEQ ID NO: 154;
(14) an amino acid sequence at least 99% identical to SEQ ID NO: 163 and an amino acid sequence at least 99% identical to SEQ ID NO: 164;
(15) an amino acid sequence at least 99% identical to SEQ ID NO: 173 and an amino acid sequence at least 99% identical to SEQ ID NO: 174;
(16) an amino acid sequence at least 99% identical to SEQ ID NO: 183 and an amino acid sequence at least 99% identical to SEQ ID NO: 184;
(17) an amino acid sequence at least 99% identical to SEQ ID NO: 193 and an amino acid sequence at least 99% identical to SEQ ID NO: 194;
(18) an amino acid sequence at least 99% identical to SEQ ID NO: 203 and an amino acid sequence at least 99% identical to SEQ ID NO: 204;
(19) an amino acid sequence at least 99% identical to SEQ ID NO: 213 and an amino acid sequence at least 99% identical to SEQ ID NO: 214;
(20) an amino acid sequence at least 99% identical to SEQ ID NO: 223 and an amino acid sequence at least 99% identical to SEQ ID NO: 224;
(21) an amino acid sequence at least 99% identical to SEQ ID NO: 233 and an amino acid sequence at least 99% identical to SEQ ID NO: 234;
(22) an amino acid sequence at least 99% identical to SEQ ID NO: 243 and an amino acid sequence at least 99% identical to SEQ ID NO: 244;
(23) an amino acid sequence at least 99% identical to SEQ ID NO: 253 and an amino acid sequence at least 99% identical to SEQ ID NO: 254;
(24) an amino acid sequence at least 99% identical to SEQ ID NO: 263 and an amino acid sequence at least 99% identical to SEQ ID NO: 264;
(25) an amino acid sequence at least 99% identical to SEQ ID NO: 273 and an amino acid sequence at least 99% identical to SEQ ID NO: 274;
(26) an amino acid sequence at least 99% identical to SEQ ID NO: 283 and an amino acid sequence at least 99% identical to SEQ ID NO: 284;
(27) an amino acid sequence at least 99% identical to SEQ ID NO: 293 and an amino acid sequence at least 99% identical to SEQ ID NO: 294;
(28) an amino acid sequence at least 99% identical to SEQ ID NO: 303 and an amino acid sequence at least 99% identical to SEQ ID NO: 304;
(29) an amino acid sequence at least 99% identical to SEQ ID NO: 313 and an amino acid sequence at least 99% identical to SEQ ID NO: 314;
(30) an amino acid sequence at least 99% identical to SEQ ID NO: 323 and an amino acid sequence at least 99% identical to SEQ ID NO: 324;
(31) an amino acid sequence at least 99% identical to SEQ ID NO: 333 and an amino acid sequence at least 99% identical to SEQ ID NO: 334;
(32) an amino acid sequence at least 99% identical to SEQ ID NO: 343 and an amino acid sequence at least 99% identical to SEQ ID NO: 344;
(33) an amino acid sequence at least 99% identical to SEQ ID NO: 353 and an amino acid sequence at least 99% identical to SEQ ID NO: 354;
(34) an amino acid sequence at least 99% identical to SEQ ID NO: 363 and an amino acid sequence at least 99% identical to SEQ ID NO: 364;
(35) an amino acid sequence at least 99% identical to SEQ ID NO: 373 and an amino acid sequence at least 99% identical to SEQ ID NO: 374;
(36) an amino acid sequence at least 99% identical to SEQ ID NO: 383 and an amino acid sequence at least 99% identical to SEQ ID NO: 384;
(37) an amino acid sequence at least 99% identical to SEQ ID NO: 393 and an amino acid sequence at least 99% identical to SEQ ID NO: 394;
(38) an amino acid sequence at least 99% identical to SEQ ID NO: 403 and an amino acid sequence at least 99% identical to SEQ ID NO: 404;
(39) an amino acid sequence at least 99% identical to SEQ ID NO: 413 and an amino acid sequence at least 99% identical to SEQ ID NO: 414;
(40) an amino acid sequence at least 99% identical to SEQ ID NO: 423 and an amino acid sequence at least 99% identical to SEQ ID NO: 424;
(41) an amino acid sequence at least 99% identical to SEQ ID NO: 433 and an amino acid sequence at least 99% identical to SEQ ID NO: 434;

(42) an amino acid sequence at least 99% identical to SEQ ID NO: 443 and an amino acid sequence at least 99% identical to SEQ ID NO: 444;
(43) an amino acid sequence at least 99% identical to SEQ ID NO: 453 and an amino acid sequence at least 99% identical to SEQ ID NO: 454;
(44) an amino acid sequence at least 99% identical to SEQ ID NO: 463 and an amino acid sequence at least 99% identical to SEQ ID NO: 464;
(45) an amino acid sequence at least 99% identical to SEQ ID NO: 483 and an amino acid sequence at least 99% identical to SEQ ID NO: 484;
(46) an amino acid sequence at least 99% identical to SEQ ID NO: 493 and an amino acid sequence at least 99% identical to SEQ ID NO: 494;
(47) an amino acid sequence at least 99% identical to amino acids 21-130 of SEQ ID NO: 33 and an amino acid sequence at least 99% identical to amino acids 22-131 of SEQ ID NO: 34;
(48) an amino acid sequence at least 99% identical to amino acids 22-135 of SEQ ID NO: 43 and an amino acid sequence at least 99% identical to amino acids 20-132 of SEQ ID NO: 44;
(49) an amino acid sequence at least 99% identical to amino acids 19-127 of SEQ ID NO: 53 and an amino acid sequence at least 99% identical to amino acids 24-134 of SEQ ID NO: 54;
(50) an amino acid sequence at least 99% identical to amino acids 21-131 of SEQ ID NO: 63 and an amino acid sequence at least 99% identical to amino acids 22-132 of SEQ ID NO: 64;
(51) an amino acid sequence at least 99% identical to amino acids 21-131 of SEQ ID NO: 73 and an amino acid sequence at least 99% identical to amino acids 22-134 of SEQ ID NO: 74;
(52) an amino acid sequence at least 99% identical to amino acids 22-137 of SEQ ID NO: 83 and an amino acid sequence at least 99% identical to amino acids 22-133 of SEQ ID NO: 84;
(53) an amino acid sequence at least 99% identical to amino acids 22-131 of SEQ ID NO: 93 and an amino acid sequence at least 99% identical to amino acids 22-134 of SEQ ID NO: 94;
(54) an amino acid sequence at least 99% identical to amino acids 21-133 of SEQ ID NO: 103 and an amino acid sequence at least 99% identical to amino acids 22-129 of SEQ ID NO: 104;
(55) an amino acid sequence at least 99% identical to amino acids 19-126 of SEQ ID NO: 113 and an amino acid sequence at least 99% identical to amino acids 22-134 of SEQ ID NO: 114;
(56) an amino acid sequence at least 99% identical to amino acids 19-128 of SEQ ID NO: 123 and an amino acid sequence at least 99% identical to amino acids 22-134 of SEQ ID NO: 124;
(57) an amino acid sequence at least 99% identical to amino acids 19-128 of SEQ ID NO: 133 and an amino acid sequence at least 99% identical to amino acids 22-134 of SEQ ID NO: 134;
(58) an amino acid sequence at least 99% identical to amino acids 21-130 of SEQ ID NO: 143 and an amino acid sequence at least 99% identical to amino acids 22-131 of SEQ ID NO: 144;
(59) an amino acid sequence at least 99% identical to amino acids 20-128 of SEQ ID NO: 153 and an amino acid sequence at least 99% identical to amino acids 22-132 of SEQ ID NO: 154;
(60) an amino acid sequence at least 99% identical to amino acids 21-135 of SEQ ID NO: 163 and an amino acid sequence at least 99% identical to amino acids 22-132 of SEQ ID NO: 164;
(61) an amino acid sequence at least 99% identical to amino acids 21-133 of SEQ ID NO: 173 and an amino acid sequence at least 99% identical to amino acids 27-131 of SEQ ID NO: 174;
(62) an amino acid sequence at least 99% identical to amino acids 19-129 of SEQ ID NO: 183 and an amino acid sequence at least 99% identical to amino acids 27-132 of SEQ ID NO: 184;
(63) an amino acid sequence at least 99% identical to amino acids 22-134 of SEQ ID NO: 193 and an amino acid sequence at least 99% identical to amino acids 20-131 of SEQ ID NO: 194;
(64) an amino acid sequence at least 99% identical to amino acids 21-135 of SEQ ID NO: 203 and an amino acid sequence at least 99% identical to amino acids 22-134 of SEQ ID NO: 204;
(65) an amino acid sequence at least 99% identical to amino acids 22-136 of SEQ ID NO: 213 and an amino acid sequence at least 99% identical to amino acids 22-134 of SEQ ID NO: 214;
(66) an amino acid sequence at least 99% identical to amino acids 22-136 of SEQ ID NO: 223 and an amino acid sequence at least 99% identical to amino acids 22-134 of SEQ ID NO: 224;
(67) an amino acid sequence at least 99% identical to amino acids 22-134 of SEQ ID NO: 233 and an amino acid sequence at least 99% identical to amino acids 22-140 of SEQ ID NO: 234;
(68) an amino acid sequence at least 99% identical to amino acids 22-134 of SEQ ID NO: 243 and an amino acid sequence at least 99% identical to amino acids 17-130 of SEQ ID NO: 244;
(69) an amino acid sequence at least 99% identical to amino acids 20-125 of SEQ ID NO: 253 and an amino acid sequence at least 99% identical to amino acids 27-134 of SEQ ID NO: 254;
(70) an amino acid sequence at least 99% identical to amino acids 21-135 of SEQ ID NO: 263 and an amino acid sequence at least 99% identical to amino acids 22-138 of SEQ ID NO: 264;
(71) an amino acid sequence at least 99% identical to amino acids 23-136 of SEQ ID NO: 273 and an amino acid sequence at least 99% identical to amino acids 22-141 of SEQ ID NO: 274;
(72) an amino acid sequence at least 99% identical to amino acids 23-136 of SEQ ID NO: 283 and an amino acid sequence at least 99% identical to amino acids 17-131 of SEQ ID NO: 284;
(73) an amino acid sequence at least 99% identical to amino acids 22-135 of SEQ ID NO: 293 and an amino acid sequence at least 99% identical to amino acids 22-134 of SEQ ID NO: 294;
(74) an amino acid sequence at least 99% identical to amino acids 22-134 of SEQ ID NO: 303 and an amino acid sequence at least 99% identical to amino acids 22-133 of SEQ ID NO: 304;
(75) an amino acid sequence at least 99% identical to amino acids 23-134 of SEQ ID NO: 313 and an amino acid sequence at least 99% identical to amino acids 22-134 of SEQ ID NO: 314;
(76) an amino acid sequence at least 99% identical to amino acids 22-136 of SEQ ID NO: 323 and an amino acid sequence at least 99% identical to amino acids 22-135 of SEQ ID NO: 324;

(77) an amino acid sequence at least 99% identical to amino acids 19-125 of SEQ ID NO: 333 and an amino acid sequence at least 99% identical to amino acids 22-133 of SEQ ID NO: 334;

(78) an amino acid sequence at least 99% identical to amino acids 22-130 of SEQ ID NO: 343 and an amino acid sequence at least 99% identical to amino acids 22-132 of SEQ ID NO: 344;

(79) an amino acid sequence at least 99% identical to amino acids 22-130 of SEQ ID NO: 353 and an amino acid sequence at least 99% identical to amino acids 22-134 of SEQ ID NO: 354;

(80) an amino acid sequence at least 99% identical to amino acids 22-130 of SEQ ID NO: 363 and an amino acid sequence at least 99% identical to amino acids 22-134 of SEQ ID NO: 364;

(81) an amino acid sequence at least 99% identical to amino acids 21-133 of SEQ ID NO: 373 and an amino acid sequence at least 99% identical to amino acids 22-125 of SEQ ID NO: 374;

(82) an amino acid sequence at least 99% identical to amino acids 20-128 of SEQ ID NO: 383 and an amino acid sequence at least 99% identical to amino acids 25-132 of SEQ ID NO: 384;

(83) an amino acid sequence at least 99% identical to amino acids 22-131 of SEQ ID NO: 393 and an amino acid sequence at least 99% identical to amino acids 22-134 of SEQ ID NO: 394;

(84) an amino acid sequence at least 99% identical to amino acids 21-134 of SEQ ID NO: 403 and an amino acid sequence at least 99% identical to amino acids 22-134 of SEQ ID NO: 404;

(85) an amino acid sequence at least 99% identical to amino acids 21-134 of SEQ ID NO: 413 and an amino acid sequence at least 99% identical to amino acids 22-134 of SEQ ID NO: 414;

(86) an amino acid sequence at least 99% identical to amino acids 21-134 of SEQ ID NO: 423 and an amino acid sequence at least 99% identical to amino acids 22-134 of SEQ ID NO: 424;

(87) an amino acid sequence at least 99% identical to amino acids 21-134 of SEQ ID NO: 433 and an amino acid sequence at least 99% identical to amino acids 22-134 of SEQ ID NO: 434;

(88) an amino acid sequence at least 99% identical to amino acids 21-133 of SEQ ID NO: 443 and an amino acid sequence at least 99% identical to amino acids 22-130 of SEQ ID NO: 444;

(89) an amino acid sequence at least 99% identical to amino acids 21-133 of SEQ ID NO: 453 and an amino acid sequence at least 99% identical to amino acids 22-130 of SEQ ID NO: 454;

(90) an amino acid sequence at least 99% identical to amino acids 21-131 of SEQ ID NO: 463 and an amino acid sequence at least 99% identical to amino acids 22-140 of SEQ ID NO: 464;

(91) an amino acid sequence at least 99% identical to amino acids 21-133 of SEQ ID NO: 483 and an amino acid sequence at least 99% identical to amino acids 22-133 of SEQ ID NO: 484; or

(92) an amino acid sequence at least 99% identical to amino acids 23-134 of SEQ ID NO: 493 and an amino acid sequence at least 99% identical to amino acids 22-132 of SEQ ID NO: 494.

3. The TCR of claim 1, wherein the TCR comprises the amino acid sequences of:
(1) both of SEQ ID NOs: 33-34;
(2) both of SEQ ID NOs: 43-44;
(3) both of SEQ ID NOs: 53-54;
(4) both of SEQ ID NOs: 63-64;
(5) both of SEQ ID NOs: 73-74;
(6) both of SEQ ID NOs: 83-84;
(7) both of SEQ ID NOs: 93-94;
(8) both of SEQ ID NOs: 103-104;
(9) both of SEQ ID NOs: 113-114;
(10) both of SEQ ID NOs: 123-124;
(11) both of SEQ ID NOs: 133-134;
(12) both of SEQ ID NOs: 143-144;
(13) both of SEQ ID NOs: 153-154;
(14) both of SEQ ID NOs: 163-164;
(15) both of SEQ ID NOs: 173-174;
(16) both of SEQ ID NOs: 183-184;
(17) both of SEQ ID NOs: 193-194;
(18) both of SEQ ID NOs: 203-204;
(19) both of SEQ ID NOs: 213-214;
(20) both of SEQ ID NOs: 223-224;
(21) both of SEQ ID NOs: 233-234;
(22) both of SEQ ID NOs: 243-244;
(23) both of SEQ ID NOs: 253-254;
(24) both of SEQ ID NOs: 263-264;
(25) both of SEQ ID NOs: 273-274;
(26) both of SEQ ID NOs: 283-284;
(27) both of SEQ ID NOs: 293-294;
(28) both of SEQ ID NOs: 303-304;
(29) both of SEQ ID NOs: 313-314;
(30) both of SEQ ID NOs: 323-324;
(31) both of SEQ ID NOs: 333-334;
(32) both of SEQ ID NOs: 343-344;
(33) both of SEQ ID NOs: 353-354;
(34) both of SEQ ID NOs: 363-364;
(35) both of SEQ ID NOs: 373-374;
(36) both of SEQ ID NOs: 383-384;
(37) both of SEQ ID NOs: 393-394;
(38) both of SEQ ID NOs: 403-404;
(39) both of SEQ ID NOs: 413-414;
(40) both of SEQ ID NOs: 423-424;
(41) both of SEQ ID NOs: 433-434;
(42) both of SEQ ID NOs: 443-444;
(43) both of SEQ ID NOs: 453-454;
(44) both of SEQ ID NOs: 463-464;
(45) both of SEQ ID NOs: 483-484;
(46) both of SEQ ID NOs: 493-494;
(47) amino acids 21-130 of SEQ ID NO: 33 and amino acids 22-131 of SEQ ID NO: 34;
(48) amino acids 22-135 of SEQ ID NO: 43 and amino acids 20-132 of SEQ ID NO: 44;
(49) amino acids 19-127 of SEQ ID NO: 53 and amino acids 24-134 of SEQ ID NO: 54;
(50) amino acids 21-131 of SEQ ID NO: 63 and amino acids 22-132 of SEQ ID NO: 64;
(51) amino acids 21-131 of SEQ ID NO: 73 and amino acids 22-134 of SEQ ID NO: 74;
(52) amino acids 22-137 of SEQ ID NO: 83 and amino acids 22-133 of SEQ ID NO: 84;
(53) amino acids 22-131 of SEQ ID NO: 93 and amino acids 22-134 of SEQ ID NO: 94;
(54) amino acids 21-133 of SEQ ID NO: 103 and amino acids 22-129 of SEQ ID NO: 104;
(55) amino acids 19-126 of SEQ ID NO: 113 and amino acids 22-134 of SEQ ID NO: 114;

(56) amino acids 19-128 of SEQ ID NO: 123 and amino acids 22-134 of SEQ ID NO: 124;
(57) amino acids 19-128 of SEQ ID NO: 133 and amino acids 22-134 of SEQ ID NO: 134;
(58) amino acids 21-130 of SEQ ID NO: 143 and amino acids 22-131 of SEQ ID NO: 144;
(59) amino acids 20-128 of SEQ ID NO: 153 and amino acids 22-132 of SEQ ID NO: 154;
(60) amino acids 21-135 of SEQ ID NO: 163 and amino acids 22-132 of SEQ ID NO: 164;
(61) amino acids 21-133 of SEQ ID NO: 173 and amino acids 27-131 of SEQ ID NO: 174;
(62) amino acids 19-129 of SEQ ID NO: 183 and amino acids 27-132 of SEQ ID NO: 184;
(63) amino acids 22-134 of SEQ ID NO: 193 and amino acids 20-131 of SEQ ID NO: 194;
(64) amino acids 21-135 of SEQ ID NO: 203 and amino acids 22-134 of SEQ ID NO: 204;
(65) amino acids 22-136 of SEQ ID NO: 213 and amino acids 22-134 of SEQ ID NO: 214;
(66) amino acids 22-136 of SEQ ID NO: 223 and amino acids 22-134 of SEQ ID NO: 224;
(67) amino acids 22-134 of SEQ ID NO: 233 and amino acids 22-140 of SEQ ID NO: 234;
(68) amino acids 22-134 of SEQ ID NO: 243 and amino acids 17-130 of SEQ ID NO: 244;
(69) amino acids 20-125 of SEQ ID NO: 253 and amino acids 27-134 of SEQ ID NO: 254;
(70) amino acids 21-135 of SEQ ID NO: 263 and amino acids 22-138 of SEQ ID NO: 264;
(71) amino acids 23-136 of SEQ ID NO: 273 and amino acids 22-141 of SEQ ID NO: 274;
(72) amino acids 23-136 of SEQ ID NO: 283 and amino acids 17-131 of SEQ ID NO: 284;
(73) amino acids 22-135 of SEQ ID NO: 293 and amino acids 22-134 of SEQ ID NO: 294;
(74) amino acids 22-134 of SEQ ID NO: 303 and amino acids 22-133 of SEQ ID NO: 304;
(75) amino acids 23-134 of SEQ ID NO: 313 and amino acids 22-134 of SEQ ID NO: 314;
(76) amino acids 22-136 of SEQ ID NO: 323 and amino acids 22-135 of SEQ ID NO: 324;
(77) amino acids 19-125 of SEQ ID NO: 333 and amino acids 22-133 of SEQ ID NO: 334;
(78) amino acids 22-130 of SEQ ID NO: 343 and amino acids 22-132 of SEQ ID NO: 344;
(79) amino acids 22-130 of SEQ ID NO: 353 and amino acids 22-134 of SEQ ID NO: 354;
(80) amino acids 22-130 of SEQ ID NO: 363 and amino acids 22-134 of SEQ ID NO: 364;
(81) amino acids 21-133 of SEQ ID NO: 373 and amino acids 22-125 of SEQ ID NO: 374;
(82) amino acids 20-128 of SEQ ID NO: 383 and amino acids 25-132 of SEQ ID NO: 384;
(83) amino acids 22-131 of SEQ ID NO: 393 and amino acids 22-134 of SEQ ID NO: 394;
(84) amino acids 21-134 of SEQ ID NO: 403 and amino acids 22-134 of SEQ ID NO: 404;
(85) amino acids 21-134 of SEQ ID NO: 413 and amino acids 22-134 of SEQ ID NO: 414;
(86) amino acids 21-134 of SEQ ID NO: 423 and amino acids 22-134 of SEQ ID NO: 424;
(87) amino acids 21-134 of SEQ ID NO: 433 and amino acids 22-134 of SEQ ID NO: 434;
(88) amino acids 21-133 of SEQ ID NO: 443 and amino acids 22-130 of SEQ ID NO: 444;
(89) amino acids 21-133 of SEQ ID NO: 453 and amino acids 22-130 of SEQ ID NO: 454;
(90) amino acids 21-131 of SEQ ID NO: 463 and amino acids 22-140 of SEQ ID NO: 464;
(91) amino acids 21-133 of SEQ ID NO: 483 and amino acids 22-133 of SEQ ID NO: 484; or
(92) amino acids 23-134 of SEQ ID NO: 493 and amino acids 22-132 of SEQ ID NO: 494.

4. The TCR of claim 1, wherein the TCR comprises:
(1) an amino acid sequence at least 99% identical to SEQ ID NO: 35 and an amino acid sequence at least 99% identical to SEQ ID NO:36;
(2) an amino acid sequence at least 99% identical to SEQ ID NO: 45 and an amino acid sequence at least 99% identical to SEQ ID NO:46;
(3) an amino acid sequence at least 99% identical to SEQ ID NO: 55 and an amino acid sequence at least 99% identical to SEQ ID NO:56;
(4) an amino acid sequence at least 99% identical to SEQ ID NO: 65 and an amino acid sequence at least 99% identical to SEQ ID NO:66;
(5) an amino acid sequence at least 99% identical to SEQ ID NO: 75 and an amino acid sequence at least 99% identical to SEQ ID NO:76;
(6) an amino acid sequence at least 99% identical to SEQ ID NO: 85 and an amino acid sequence at least 99% identical to SEQ ID NO:86;
(7) an amino acid sequence at least 99% identical to SEQ ID NO: 95 and an amino acid sequence at least 99% identical to SEQ ID NO:96;
(8) an amino acid sequence at least 99% identical to SEQ ID NO: 105 and an amino acid sequence at least 99% identical to SEQ ID NO:106;
(9) an amino acid sequence at least 99% identical to SEQ ID NO: 115 and an amino acid sequence at least 99% identical to SEQ ID NO:116;
(10) an amino acid sequence at least 99% identical to SEQ ID NO: 125 and an amino acid sequence at least 99% identical to SEQ ID NO:126;
(11) an amino acid sequence at least 99% identical to SEQ ID NO: 135 and an amino acid sequence at least 99% identical to SEQ ID NO:136;
(12) an amino acid sequence at least 99% identical to SEQ ID NO: 145 and an amino acid sequence at least 99% identical to SEQ ID NO:146;
(13) an amino acid sequence at least 99% identical to SEQ ID NO: 155 and an amino acid sequence at least 99% identical to SEQ ID NO:156;
(14) an amino acid sequence at least 99% identical to SEQ ID NO: 165 and an amino acid sequence at least 99% identical to SEQ ID NO:166;
(15) an amino acid sequence at least 99% identical to SEQ ID NO: 175 and an amino acid sequence at least 99% identical to SEQ ID NO:176;
(16) an amino acid sequence at least 99% identical to SEQ ID NO: 185 and an amino acid sequence at least 99% identical to SEQ ID NO:186;
(17) an amino acid sequence at least 99% identical to SEQ ID NO: 195 and an amino acid sequence at least 99% identical to SEQ ID NO:196;
(18) an amino acid sequence at least 99% identical to SEQ ID NO: 205 and an amino acid sequence at least 99% identical to SEQ ID NO:206;
(19) an amino acid sequence at least 99% identical to SEQ ID NO: 215 and an amino acid sequence at least 99% identical to SEQ ID NO:216;

(20) an amino acid sequence at least 99% identical to SEQ ID NO: 225 and an amino acid sequence at least 99% identical to SEQ ID NO:226;
(21) an amino acid sequence at least 99% identical to SEQ ID NO: 235 and an amino acid sequence at least 99% identical to SEQ ID NO:236;
(22) an amino acid sequence at least 99% identical to SEQ ID NO: 245 and an amino acid sequence at least 99% identical to SEQ ID NO:246;
(23) an amino acid sequence at least 99% identical to SEQ ID NO: 255 and an amino acid sequence at least 99% identical to SEQ ID NO:256;
(24) an amino acid sequence at least 99% identical to SEQ ID NO: 265 and an amino acid sequence at least 99% identical to SEQ ID NO:266;
(25) an amino acid sequence at least 99% identical to SEQ ID NO: 275 and an amino acid sequence at least 99% identical to SEQ ID NO:276;
(26) an amino acid sequence at least 99% identical to SEQ ID NO: 285 and an amino acid sequence at least 99% identical to SEQ ID NO:286;
(27) an amino acid sequence at least 99% identical to SEQ ID NO: 295 and an amino acid sequence at least 99% identical to SEQ ID NO:296;
(28) an amino acid sequence at least 99% identical to SEQ ID NO: 305 and an amino acid sequence at least 99% identical to SEQ ID NO:306;
(29) an amino acid sequence at least 99% identical to SEQ ID NO: 315 and an amino acid sequence at least 99% identical to SEQ ID NO:316;
(30) an amino acid sequence at least 99% identical to SEQ ID NO: 325 and an amino acid sequence at least 99% identical to SEQ ID NO:326;
(31) an amino acid sequence at least 99% identical to SEQ ID NO: 335 and an amino acid sequence at least 99% identical to SEQ ID NO:336;
(32) an amino acid sequence at least 99% identical to SEQ ID NO: 345 and an amino acid sequence at least 99% identical to SEQ ID NO:346;
(33) an amino acid sequence at least 99% identical to SEQ ID NO: 355 and an amino acid sequence at least 99% identical to SEQ ID NO:356;
(34) an amino acid sequence at least 99% identical to SEQ ID NO: 365 and an amino acid sequence at least 99% identical to SEQ ID NO:366;
(35) an amino acid sequence at least 99% identical to SEQ ID NO: 375 and an amino acid sequence at least 99% identical to SEQ ID NO:376;
(36) an amino acid sequence at least 99% identical to SEQ ID NO: 385 and an amino acid sequence at least 99% identical to SEQ ID NO:386;
(37) an amino acid sequence at least 99% identical to SEQ ID NO: 395 and an amino acid sequence at least 99% identical to SEQ ID NO:396;
(38) an amino acid sequence at least 99% identical to SEQ ID NO: 405 and an amino acid sequence at least 99% identical to SEQ ID NO:406;
(39) an amino acid sequence at least 99% identical to SEQ ID NO: 415 and an amino acid sequence at least 99% identical to SEQ ID NO:416;
(40) an amino acid sequence at least 99% identical to SEQ ID NO: 425 and an amino acid sequence at least 99% identical to SEQ ID NO:426;
(41) an amino acid sequence at least 99% identical to SEQ ID NO: 435 and an amino acid sequence at least 99% identical to SEQ ID NO:436;
(42) an amino acid sequence at least 99% identical to SEQ ID NO: 445 and an amino acid sequence at least 99% identical to SEQ ID NO:446;
(43) an amino acid sequence at least 99% identical to SEQ ID NO: 455 and an amino acid sequence at least 99% identical to SEQ ID NO:456;
(44) an amino acid sequence at least 99% identical to SEQ ID NO: 465 and an amino acid sequence at least 99% identical to SEQ ID NO:466;
(45) an amino acid sequence at least 99% identical to SEQ ID NO: 485 and an amino acid sequence at least 99% identical to SEQ ID NO:486;
(46) an amino acid sequence at least 99% identical to SEQ ID NO: 495 and an amino acid sequence at least 99% identical to SEQ ID NO:496
(47) an amino acid sequence at least 99% identical to amino acids 21-267 of SEQ ID NO: 35 and an amino acid sequence at least 99% identical to amino acids 22-304 of SEQ ID NO: 36;
(48) an amino acid sequence at least 99% identical to amino acids 22-272 of SEQ ID NO: 45 and an amino acid sequence at least 99% identical to amino acids 20-305 of SEQ ID NO: 46;
(49) an amino acid sequence at least 99% identical to amino acids 19-264 of SEQ ID NO: 55 and an amino acid sequence at least 99% identical to amino acids 24-307 of SEQ ID NO: 56;
(50) an amino acid sequence at least 99% identical to amino acids 21-268 of SEQ ID NO: 65 and an amino acid sequence at least 99% identical to amino acids 22-305 of SEQ ID NO: 66;
(51) an amino acid sequence at least 99% identical to amino acids 21-268 of SEQ ID NO: 75 and an amino acid sequence at least 99% identical to amino acids 22-307 of SEQ ID NO: 76;
(52) an amino acid sequence at least 99% identical to amino acids 22-274 of SEQ ID NO: 85 and an amino acid sequence at least 99% identical to amino acids 22-306 of SEQ ID NO: 86;
(53) an amino acid sequence at least 99% identical to amino acids 22-268 of SEQ ID NO: 95 and an amino acid sequence at least 99% identical to amino acids 22-307 of SEQ ID NO: 96;
(54) an amino acid sequence at least 99% identical to amino acids 21-270 of SEQ ID NO: 105 and an amino acid sequence at least 99% identical to amino acids 22-302 of SEQ ID NO: 106;
(55) an amino acid sequence at least 99% identical to amino acids 19-263 of SEQ ID NO: 115 and an amino acid sequence at least 99% identical to amino acids 22-307 of SEQ ID NO: 116;
(56) an amino acid sequence at least 99% identical to amino acids 19-265 of SEQ ID NO: 125 and an amino acid sequence at least 99% identical to amino acids 22-307 of SEQ ID NO: 126;
(57) an amino acid sequence at least 99% identical to amino acids 19-265 of SEQ ID NO: 135 and an amino acid sequence at least 99% identical to amino acids 22-307 of SEQ ID NO: 136;
(58) an amino acid sequence at least 99% identical to amino acids 21-267 of SEQ ID NO: 145 and an amino acid sequence at least 99% identical to amino acids 22-304 of SEQ ID NO:146;
(59) an amino acid sequence at least 99% identical to amino acids 20-265 of SEQ ID NO: 155 and an amino acid sequence at least 99% identical to amino acids 22-305 of SEQ ID NO: 156;

(60) an amino acid sequence at least 99% identical to amino acids 21-272 of SEQ ID NO: 165 and an amino acid sequence at least 99% identical to amino acids 22-305 of SEQ ID NO: 166;
(61) an amino acid sequence at least 99% identical to amino acids 21-270 of SEQ ID NO: 175 and an amino acid sequence at least 99% identical to amino acids 27-304 of SEQ ID NO: 176;
(62) an amino acid sequence at least 99% identical to amino acids 19-266 of SEQ ID NO: 185 and an amino acid sequence at least 99% identical to amino acids 27-305 of SEQ ID NO: 186;
(63) an amino acid sequence at least 99% identical to amino acids 22-271 of SEQ ID NO: 195 and an amino acid sequence at least 99% identical to amino acids 20-304 of SEQ ID NO: 196;
(64) an amino acid sequence at least 99% identical to amino acids 21-272 of SEQ ID NO: 205 and an amino acid sequence at least 99% identical to amino acids 22-307 of SEQ ID NO: 206;
(65) an amino acid sequence at least 99% identical to amino acids 22-273 of SEQ ID NO: 215 and an amino acid sequence at least 99% identical to amino acids 22-307 of SEQ ID NO: 216;
(66) an amino acid sequence at least 99% identical to amino acids 22-273 of SEQ ID NO: 225 and an amino acid sequence at least 99% identical to amino acids 22-307 of SEQ ID NO: 226;
(67) an amino acid sequence at least 99% identical to amino acids 22-271 of SEQ ID NO: 235 and an amino acid sequence at least 99% identical to amino acids 22-313 of SEQ ID NO: 236;
(68) an amino acid sequence at least 99% identical to amino acids 22-271 of SEQ ID NO: 245 and an amino acid sequence at least 99% identical to amino acids 17-303 of SEQ ID NO: 246;
(69) an amino acid sequence at least 99% identical to amino acids 20-262 of SEQ ID NO: 255 and an amino acid sequence at least 99% identical to amino acids 27-307 of SEQ ID NO: 256;
(70) an amino acid sequence at least 99% identical to amino acids 21-272 of SEQ ID NO: 265 and an amino acid sequence at least 99% identical to amino acids 22-311 of SEQ ID NO: 266;
(71) an amino acid sequence at least 99% identical to amino acids 23-273 of SEQ ID NO: 275 and an amino acid sequence at least 99% identical to amino acids 22-314 of SEQ ID NO: 276;
(72) an amino acid sequence at least 99% identical to amino acids 23-273 of SEQ ID NO: 285 and an amino acid sequence at least 99% identical to amino acids 17-304 of SEQ ID NO: 286;
(73) an amino acid sequence at least 99% identical to amino acids 22-272 of SEQ ID NO: 295 and an amino acid sequence at least 99% identical to amino acids 22-307 of SEQ ID NO: 296;
(74) an amino acid sequence at least 99% identical to amino acids 22-271 of SEQ ID NO: 305 and an amino acid sequence at least 99% identical to amino acids 22-306 of SEQ ID NO: 306;
(75) an amino acid sequence at least 99% identical to amino acids 23-271 of SEQ ID NO: 315 and an amino acid sequence at least 99% identical to amino acids 22-307 of SEQ ID NO: 316;
(76) an amino acid sequence at least 99% identical to amino acids 22-273 of SEQ ID NO: 325 and an amino acid sequence at least 99% identical to amino acids 22-308 of SEQ ID NO: 326;
(77) an amino acid sequence at least 99% identical to amino acids 19-262 of SEQ ID NO: 335 and an amino acid sequence at least 99% identical to amino acids 22-306 of SEQ ID NO: 336;
(78) an amino acid sequence at least 99% identical to amino acids 22-267 of SEQ ID NO: 345 and an amino acid sequence at least 99% identical to amino acids 22-305 of SEQ ID NO: 346;
(79) an amino acid sequence at least 99% identical to amino acids 22-267 of SEQ ID NO: 355 and an amino acid sequence at least 99% identical to amino acids 22-307 of SEQ ID NO: 356;
(80) an amino acid sequence at least 99% identical to amino acids 22-267 of SEQ ID NO: 365 and an amino acid sequence at least 99% identical to amino acids 22-307 of SEQ ID NO: 366;
(81) an amino acid sequence at least 99% identical to amino acids 21-270 of SEQ ID NO: 375 and an amino acid sequence at least 99% identical to amino acids 22-298 of SEQ ID NO: 376;
(82) an amino acid sequence at least 99% identical to amino acids 20-265 of SEQ ID NO: 385 and an amino acid sequence at least 99% identical to amino acids 25-305 of SEQ ID NO: 386;
(83) an amino acid sequence at least 99% identical to amino acids 22-268 of SEQ ID NO: 395 and an amino acid sequence at least 99% identical to amino acids 22-307 of SEQ ID NO: 396;
(84) an amino acid sequence at least 99% identical to amino acids 21-271 of SEQ ID NO: 405 and an amino acid sequence at least 99% identical to amino acids 22-307 of SEQ ID NO: 406;
(85) an amino acid sequence at least 99% identical to amino acids 21-271 of SEQ ID NO: 415 and an amino acid sequence at least 99% identical to amino acids 22-307 of SEQ ID NO: 416;
(86) an amino acid sequence at least 99% identical to amino acids 21-271 of SEQ ID NO: 425 and an amino acid sequence at least 99% identical to amino acids 22-307 of SEQ ID NO: 426;
(87) an amino acid sequence at least 99% identical to amino acids 21-271 of SEQ ID NO: 435 and an amino acid sequence at least 99% identical to amino acids 22-307 of SEQ ID NO: 436;
(88) an amino acid sequence at least 99% identical to amino acids 21-270 of SEQ ID NO: 445 and an amino acid sequence at least 99% identical to amino acids 22-303 of SEQ ID NO: 446;
(89) an amino acid sequence at least 99% identical to amino acids 21-270 of SEQ ID NO: 455 and an amino acid sequence at least 99% identical to amino acids 22-303 of SEQ ID NO: 456;
(90) an amino acid sequence at least 99% identical to amino acids 21-268 of SEQ ID NO: 465 and an amino acid sequence at least 99% identical to amino acids 22-313 of SEQ ID NO: 466;
(91) an amino acid sequence at least 99% identical to amino acids 21-270 of SEQ ID NO: 485 and an amino acid sequence at least 99% identical to amino acids 22-306 of SEQ ID NO: 486; or
(92) an amino acid sequence at least 99% identical to amino acids 23-271 of SEQ ID NO: 495 and an amino acid sequence at least 99% identical to amino acids 22-305 of SEQ ID NO: 496.

5. The TCR of claim 1, wherein the TCR comprises the amino acid sequences of:
(1) both of SEQ ID NOs: 35-36;
(2) both of SEQ ID NOs: 45-46;
(3) both of SEQ ID NOs: 55-56;
(4) both of SEQ ID NOs: 65-66;
(5) both of SEQ ID NOs: 75-76;
(6) both of SEQ ID NOs: 85-86;
(7) both of SEQ ID NOs: 95-96;
(8) both of SEQ ID NOs: 105-106;
(9) both of SEQ ID NOs: 115-116;
(10) both of SEQ ID NOs: 125-126;
(11) both of SEQ ID NOs: 135-136;
(12) both of SEQ ID NOs: 145-146;
(13) both of SEQ ID NOs: 155-156;
(14) both of SEQ ID NOs: 165-166;
(15) both of SEQ ID NOs: 175-176;
(16) both of SEQ ID NOs: 185-186;
(17) both of SEQ ID NOs: 195-196;
(18) both of SEQ ID NOs: 205-206;
(19) both of SEQ ID NOs: 215-216;
(20) both of SEQ ID NOs: 225-226;
(21) both of SEQ ID NOs: 235-236;
(22) both of SEQ ID NOs: 245-246;
(23) both of SEQ ID NOs: 255-256;
(24) both of SEQ ID NOs: 265-266;
(25) both of SEQ ID NOs: 275-276;
(26) both of SEQ ID NOs: 285-286;
(27) both of SEQ ID NOs: 295-296;
(28) both of SEQ ID NOs: 305-306;
(29) both of SEQ ID NOs: 315-316;
(30) both of SEQ ID NOs: 325-326;
(31) both of SEQ ID NOs: 335-336;
(32) both of SEQ ID NOs: 345-346;
(33) both of SEQ ID NOs: 355-356;
(34) both of SEQ ID NOs: 365-366;
(35) both of SEQ ID NOs: 375-376;
(36) both of SEQ ID NOs: 385-386;
(37) both of SEQ ID NOs: 395-396;
(38) both of SEQ ID NOs: 405-406;
(39) both of SEQ ID NOs: 415-416;
(40) both of SEQ ID NOs: 425-426;
(41) both of SEQ ID NOs: 435-436;
(42) both of SEQ ID NOs: 445-446;
(43) both of SEQ ID NOs: 455-456;
(44) both of SEQ ID NOs: 465-466;
(45) both of SEQ ID NOs: 485-486;
(46) both of SEQ ID NOs: 495-496;
(47) amino acids 21-267 of SEQ ID NO: 35 and amino acids 22-304 of SEQ ID NO: 36;
(48) amino acids 22-272 of SEQ ID NO: 45 and amino acids 20-305 of SEQ ID NO: 46;
(49) amino acids 19-264 of SEQ ID NO: 55 and amino acids 24-307 of SEQ ID NO: 56;
(50) amino acids 21-268 of SEQ ID NO: 65 and amino acids 22-305 of SEQ ID NO: 66;
(51) amino acids 21-268 of SEQ ID NO: 75 and amino acids 22-307 of SEQ ID NO: 76;
(52) amino acids 22-274 of SEQ ID NO: 85 and amino acids 22-306 of SEQ ID NO: 86;
(53) amino acids 22-268 of SEQ ID NO: 95 and amino acids 22-307 of SEQ ID NO: 96;
(54) amino acids 21-270 of SEQ ID NO: 105 and amino acids 22-302 of SEQ ID NO: 106;
(55) amino acids 19-263 of SEQ ID NO: 115 and amino acids 22-307 of SEQ ID NO: 116;
(56) amino acids 19-265 of SEQ ID NO: 125 and amino acids 22-307 of SEQ ID NO: 126;
(57) amino acids 19-265 of SEQ ID NO: 135 and amino acids 22-307 of SEQ ID NO: 136;
(58) amino acids 21-267 of SEQ ID NO: 145 and amino acids 22-304 of SEQ ID NO: 146;
(59) amino acids 20-265 of SEQ ID NO: 155 and amino acids 22-305 of SEQ ID NO: 156;
(60) amino acids 21-272 of SEQ ID NO: 165 and amino acids 22-305 of SEQ ID NO: 166;
(61) amino acids 21-270 of SEQ ID NO: 175 and amino acids 27-304 of SEQ ID NO: 176;
(62) amino acids 19-266 of SEQ ID NO: 185 and amino acids 27-305 of SEQ ID NO: 186;
(63) amino acids 22-271 of SEQ ID NO: 195 and amino acids 20-304 of SEQ ID NO: 196;
(64) amino acids 21-272 of SEQ ID NO: 205 and amino acids 22-307 of SEQ ID NO: 206;
(65) amino acids 22-273 of SEQ ID NO: 215 and amino acids 22-307 of SEQ ID NO: 216;
(66) amino acids 22-273 of SEQ ID NO: 225 and amino acids 22-307 of SEQ ID NO: 226;
(67) amino acids 22-271 of SEQ ID NO: 235 and amino acids 22-313 of SEQ ID NO: 236;
(68) amino acids 22-271 of SEQ ID NO: 245 and amino acids 17-303 of SEQ ID NO: 246;
(69) amino acids 20-262 of SEQ ID NO: 255 and amino acids 27-307 of SEQ ID NO: 256;
(70) amino acids 21-272 of SEQ ID NO: 265 and amino acids 22-311 of SEQ ID NO: 266;
(71) amino acids 23-273 of SEQ ID NO: 275 and amino acids 22-314 of SEQ ID NO: 276;
(72) amino acids 23-273 of SEQ ID NO: 285 and amino acids 17-304 of SEQ ID NO: 286;
(73) amino acids 22-272 of SEQ ID NO: 295 and amino acids 22-307 of SEQ ID NO: 296;
(74) amino acids 22-271 of SEQ ID NO: 305 and amino acids 22-306 of SEQ ID NO: 306;
(75) amino acids 23-271 of SEQ ID NO: 315 and amino acids 22-307 of SEQ ID NO: 316;
(76) amino acids 22-273 of SEQ ID NO: 325 and amino acids 22-308 of SEQ ID NO: 326;
(77) amino acids 19-262 of SEQ ID NO: 335 and amino acids 22-306 of SEQ ID NO: 336;
(78) amino acids 22-267 of SEQ ID NO: 345 and amino acids 22-305 of SEQ ID NO: 346;
(79) amino acids 22-267 of SEQ ID NO: 355 and amino acids 22-307 of SEQ ID NO: 356;
(80) amino acids 22-267 of SEQ ID NO: 365 and amino acids 22-307 of SEQ ID NO: 366;
(81) amino acids 21-270 of SEQ ID NO: 375 and amino acids 22-298 of SEQ ID NO: 376;
(82) amino acids 20-265 of SEQ ID NO: 385 and amino acids 25-305 of SEQ ID NO: 386;
(83) amino acids 22-268 of SEQ ID NO: 395 and amino acids 22-307 of SEQ ID NO: 396;
(84) amino acids 21-271 of SEQ ID NO: 405 and amino acids 22-307 of SEQ ID NO: 406;
(85) amino acids 21-271 of SEQ ID NO: 415 and amino acids 22-307 of SEQ ID NO: 416;
(86) amino acids 21-271 of SEQ ID NO: 425 and amino acids 22-307 of SEQ ID NO: 426;
(87) amino acids 21-271 of SEQ ID NO: 435 and amino acids 22-307 of SEQ ID NO: 436;
(88) amino acids 21-270 of SEQ ID NO: 445 and amino acids 22-303 of SEQ ID NO: 446;

(89) amino acids 21-270 of SEQ ID NO: 455 and amino acids 22-303 of SEQ ID NO: 456;
(90) amino acids 21-268 of SEQ ID NO: 465 and amino acids 22-313 of SEQ ID NO: 466;
(91) amino acids 21-270 of SEQ ID NO: 485 and amino acids 22-306 of SEQ ID NO: 486; or
(92) amino acids 23-271 of SEQ ID NO: 495 and amino acids 22-305 of SEQ ID NO: 496.

6. An isolated or purified nucleic acid comprising a nucleotide sequence encoding the TCR according to claim 1.

7. A recombinant expression vector comprising the nucleic acid according to claim 6.

8. An isolated or purified host cell comprising the recombinant expression vector according to claim 7 or an isolated or purified population of cells comprising the host cell.

9. A pharmaceutical composition comprising (a) the TCR according to claim 1 and (b) a pharmaceutically acceptable carrier.

10. An isolated or purified polypeptide comprising a functional portion of a TCR having antigenic specificity for mutated human p53, wherein the mutated human p53 has one of the following human p53 mutations: R175H, Y220C, G245S, R248Q, or R248W, wherein the human p53 mutations are defined by reference to SEQ ID NO: 1, and wherein the functional portion comprises the amino acid sequences of:
(1) all of SEQ ID NOs: 27-32;
(2) all of SEQ ID NOs: 37-42;
(3) all of SEQ ID NOs: 47-52;
(4) all of SEQ ID NOs: 57-62;
(5) all of SEQ ID NOs: 67-72;
(6) all of SEQ ID NOs: 77-82;
(7) all of SEQ ID NOs: 87-92;
(8) all of SEQ ID NOs: 97-102;
(9) all of SEQ ID NOs: 107-112;
(10) all of SEQ ID NOs: 117-122;
(11) all of SEQ ID NOs: 127-132;
(12) all of SEQ ID NOs: 137-142;
(13) all of SEQ ID NOs: 147-152;
(14) all of SEQ ID NOs: 157-162;
(15) all of SEQ ID NOs: 167-172;
(16) all of SEQ ID NOs: 177-182;
(17) all of SEQ ID NOs: 187-192;
(18) all of SEQ ID NOs: 197-202;
(19) all of SEQ ID NOs: 207-212;
(20) all of SEQ ID NOs: 217-222;
(21) all of SEQ ID NOs: 227-232;
(22) all of SEQ ID NOs: 237-242;
(23) all of SEQ ID NOs: 247-252;
(24) all of SEQ ID NOs: 257-262;
(25) all of SEQ ID NOs: 267-272;
(26) all of SEQ ID NOs: 277-282;
(27) all of SEQ ID NOs: 287-292;
(28) all of SEQ ID NOs: 297-302;
(29) all of SEQ ID NOs: 307-312;
(30) all of SEQ ID NOs: 317-322;
(31) all of SEQ ID NOs: 327-332;
(32) all of SEQ ID NOs: 337-342;
(33) all of SEQ ID NOs: 347-352;
(34) all of SEQ ID NOs: 357-362;
(35) all of SEQ ID NOs: 367-372;
(36) all of SEQ ID NOs: 377-382;
(37) all of SEQ ID NOs: 387-392;
(38) all of SEQ ID NOs: 397-402;
(39) all of SEQ ID NOs: 407-412;
(40) all of SEQ ID NOs: 417-422;
(41) all of SEQ ID NOs: 427-432;
(42) all of SEQ ID NOs: 437-442;
(43) all of SEQ ID NOs: 447-452;
(44) all of SEQ ID NOs: 457-462;
(45) all of SEQ ID NOs: 477-482; or
(46) all of SEQ ID NOs: 487-492.

11. The polypeptide of claim 10, wherein the functional portion comprises:
(1) an amino acid sequence at least 99% identical to SEQ ID NO: 33 and an amino acid sequence at least 99% identical to SEQ ID NO: 34;
(2) an amino acid sequence at least 99% identical to SEQ ID NO: 43 and an amino acid sequence at least 99% identical to SEQ ID NO: 44;
(3) an amino acid sequence at least 99% identical to SEQ ID NO: 53 and an amino acid sequence at least 99% identical to SEQ ID NO: 54;
(4) an amino acid sequence at least 99% identical to SEQ ID NO: 63 and an amino acid sequence at least 99% identical to SEQ ID NO: 64;
(5) an amino acid sequence at least 99% identical to SEQ ID NO: 73 and an amino acid sequence at least 99% identical to SEQ ID NO: 74;
(6) an amino acid sequence at least 99% identical to SEQ ID NO: 83 and an amino acid sequence at least 99% identical to SEQ ID NO: 84;
(7) an amino acid sequence at least 99% identical to SEQ ID NO: 93 and an amino acid sequence at least 99% identical to SEQ ID NO: 94;
(8) an amino acid sequence at least 99% identical to SEQ ID NO: 103 and an amino acid sequence at least 99% identical to SEQ ID NO: 104;
(9) an amino acid sequence at least 99% identical to SEQ ID NO: 113 and an amino acid sequence at least 99% identical to SEQ ID NO: 114;
(10) an amino acid sequence at least 99% identical to SEQ ID NO: 123 and an amino acid sequence at least 99% identical to SEQ ID NO: 124;
(11) an amino acid sequence at least 99% identical to SEQ ID NO: 133 and an amino acid sequence at least 99% identical to SEQ ID NO: 134;
(12) an amino acid sequence at least 99% identical to SEQ ID NO: 143 and an amino acid sequence at least 99% identical to SEQ ID NO: 144;
(13) an amino acid sequence at least 99% identical to SEQ ID NO: 153 and an amino acid sequence at least 99% identical to SEQ ID NO: 154;
(14) an amino acid sequence at least 99% identical to SEQ ID NO: 163 and an amino acid sequence at least 99% identical to SEQ ID NO: 164;
(15) an amino acid sequence at least 99% identical to SEQ ID NO: 173 and an amino acid sequence at least 99% identical to SEQ ID NO: 174;
(16) an amino acid sequence at least 99% identical to SEQ ID NO: 183 and an amino acid sequence at least 99% identical to SEQ ID NO: 184;
(17) an amino acid sequence at least 99% identical to SEQ ID NO: 193 and an amino acid sequence at least 99% identical to SEQ ID NO: 194;
(18) an amino acid sequence at least 99% identical to SEQ ID NO: 203 and an amino acid sequence at least 99% identical to SEQ ID NO: 204;
(19) an amino acid sequence at least 99% identical to SEQ ID NO: 213 and an amino acid sequence at least 99% identical to SEQ ID NO: 214;
(20) an amino acid sequence at least 99% identical to SEQ ID NO: 223 and an amino acid sequence at least 99% identical to SEQ ID NO: 224;

(21) an amino acid sequence at least 99% identical to SEQ ID NO: 233 and an amino acid sequence at least 99% identical to SEQ ID NO: 234;
(22) an amino acid sequence at least 99% identical to SEQ ID NO: 243 and an amino acid sequence at least 99% identical to SEQ ID NO: 244;
(23) an amino acid sequence at least 99% identical to SEQ ID NO: 253 and an amino acid sequence at least 99% identical to SEQ ID NO: 254;
(24) an amino acid sequence at least 99% identical to SEQ ID NO: 263 and an amino acid sequence at least 99% identical to SEQ ID NO: 264;
(25) an amino acid sequence at least 99% identical to SEQ ID NO: 273 and an amino acid sequence at least 99% identical to SEQ ID NO: 274;
(26) an amino acid sequence at least 99% identical to SEQ ID NO: 283 and an amino acid sequence at least 99% identical to SEQ ID NO: 284;
(27) an amino acid sequence at least 99% identical to SEQ ID NO: 293 and an amino acid sequence at least 99% identical to SEQ ID NO: 294;
(28) an amino acid sequence at least 99% identical to SEQ ID NO: 303 and an amino acid sequence at least 99% identical to SEQ ID NO: 304;
(29) an amino acid sequence at least 99% identical to SEQ ID NO: 313 and an amino acid sequence at least 99% identical to SEQ ID NO: 314;
(30) an amino acid sequence at least 99% identical to SEQ ID NO: 323 and an amino acid sequence at least 99% identical to SEQ ID NO: 324;
(31) an amino acid sequence at least 99% identical to SEQ ID NO: 333 and an amino acid sequence at least 99% identical to SEQ ID NO: 334;
(32) an amino acid sequence at least 99% identical to SEQ ID NO: 343 and an amino acid sequence at least 99% identical to SEQ ID NO: 344;
(33) an amino acid sequence at least 99% identical to SEQ ID NO: 353 and an amino acid sequence at least 99% identical to SEQ ID NO: 354;
(34) an amino acid sequence at least 99% identical to SEQ ID NO: 363 and an amino acid sequence at least 99% identical to SEQ ID NO: 364;
(35) an amino acid sequence at least 99% identical to SEQ ID NO: 373 and an amino acid sequence at least 99% identical to SEQ ID NO: 374;
(36) an amino acid sequence at least 99% identical to SEQ ID NO: 383 and an amino acid sequence at least 99% identical to SEQ ID NO: 384;
(37) an amino acid sequence at least 99% identical to SEQ ID NO: 393 and an amino acid sequence at least 99% identical to SEQ ID NO: 394;
(38) an amino acid sequence at least 99% identical to SEQ ID NO: 403 and an amino acid sequence at least 99% identical to SEQ ID NO: 404;
(39) an amino acid sequence at least 99% identical to SEQ ID NO: 413 and an amino acid sequence at least 99% identical to SEQ ID NO: 414;
(40) an amino acid sequence at least 99% identical to SEQ ID NO: 423 and an amino acid sequence at least 99% identical to SEQ ID NO: 424;
(41) an amino acid sequence at least 99% identical to SEQ ID NO: 433 and an amino acid sequence at least 99% identical to SEQ ID NO: 434;
(42) an amino acid sequence at least 99% identical to SEQ ID NO: 443 and an amino acid sequence at least 99% identical to SEQ ID NO: 444;
(43) an amino acid sequence at least 99% identical to SEQ ID NO: 453 and an amino acid sequence at least 99% identical to SEQ ID NO: 454;
(44) an amino acid sequence at least 99% identical to SEQ ID NO: 463 and an amino acid sequence at least 99% identical to SEQ ID NO: 464;
(45) an amino acid sequence at least 99% identical to SEQ ID NO: 483 and an amino acid sequence at least 99% identical to SEQ ID NO: 484;
(46) an amino acid sequence at least 99% identical to SEQ ID NO: 493 and an amino acid sequence at least 99% identical to SEQ ID NO: 494
(47) an amino acid sequence at least 99% identical to amino acids 21-130 of SEQ ID NO: 33 and an amino acid sequence at least 99% identical to amino acids 22-131 of SEQ ID NO: 34;
(48) an amino acid sequence at least 99% identical to amino acids 22-135 of SEQ ID NO: 43 and an amino acid sequence at least 99% identical to amino acids 20-132 of SEQ ID NO: 44;
(49) an amino acid sequence at least 99% identical to amino acids 19-127 of SEQ ID NO: 53 and an amino acid sequence at least 99% identical to amino acids 24-134 of SEQ ID NO: 54;
(50) an amino acid sequence at least 99% identical to amino acids 21-131 of SEQ ID NO: 63 and an amino acid sequence at least 99% identical to amino acids 22-132 of SEQ ID NO: 64;
(51) an amino acid sequence at least 99% identical to amino acids 21-131 of SEQ ID NO: 73 and an amino acid sequence at least 99% identical to amino acids 22-134 of SEQ ID NO: 74;
(52) an amino acid sequence at least 99% identical to amino acids 22-137 of SEQ ID NO: 83 and an amino acid sequence at least 99% identical to amino acids 22-133 of SEQ ID NO: 84;
(53) an amino acid sequence at least 99% identical to amino acids 22-131 of SEQ ID NO: 93 and an amino acid sequence at least 99% identical to amino acids 22-134 of SEQ ID NO: 94;
(54) an amino acid sequence at least 99% identical to amino acids 21-133 of SEQ ID NO: 103 and an amino acid sequence at least 99% identical to amino acids 22-129 of SEQ ID NO: 104;
(55) an amino acid sequence at least 99% identical to amino acids 19-126 of SEQ ID NO: 113 and an amino acid sequence at least 99% identical to amino acids 22-134 of SEQ ID NO: 114;
(56) an amino acid sequence at least 99% identical to amino acids 19-128 of SEQ ID NO: 123 and an amino acid sequence at least 99% identical to amino acids 22-134 of SEQ ID NO: 124;
(57) an amino acid sequence at least 99% identical to amino acids 19-128 of SEQ ID NO: 133 and an amino acid sequence at least 99% identical to amino acids 22-134 of SEQ ID NO: 134;
(58) an amino acid sequence at least 99% identical to amino acids 21-130 of SEQ ID NO: 143 and an amino acid sequence at least 99% identical to amino acids 22-131 of SEQ ID NO: 144;
(59) an amino acid sequence at least 99% identical to amino acids 20-128 of SEQ ID NO: 153 and an amino acid sequence at least 99% identical to amino acids 22-132 of SEQ ID NO: 154;
(60) an amino acid sequence at least 99% identical to amino acids 21-135 of SEQ ID NO: 163 and an amino acid sequence at least 99% identical to amino acids 22-132 of SEQ ID NO: 164;
(61) an amino acid sequence at least 99% identical to amino acids 21-133 of SEQ ID NO: 173 and an amino acid sequence at least 99% identical to amino acids 27-131 of SEQ ID NO: 174;
(62) an amino acid sequence at least 99% identical to amino acids 19-129 of SEQ ID NO: 183 and an amino acid sequence at least 99% identical to amino acids 27-132 of SEQ ID NO: 184;
(63) an amino acid sequence at least 99% identical to amino acids 22-134 of SEQ ID NO: 193 and an amino acid sequence at least 99% identical to amino acids 20-131 of SEQ ID NO: 194;
(64) an amino acid sequence at least 99% identical to amino acids 21-135 of SEQ ID NO: 203 and an amino acid sequence at least 99% identical to amino acids 22-134 of SEQ ID NO: 204;
(65) an amino acid sequence at least 99% identical to amino acids 22-136 of SEQ ID NO: 213 and an amino acid sequence at least 99% identical to amino acids 22-134 of SEQ ID NO: 214;
(66) an amino acid sequence at least 99% identical to amino acids 22-136 of SEQ ID NO: 223 and an amino acid sequence at least 99% identical to amino acids 22-134 of SEQ ID NO: 224;
(67) an amino acid sequence at least 99% identical to amino acids 22-134 of SEQ ID NO: 233 and an amino acid sequence at least 99% identical to amino acids 22-140 of SEQ ID NO: 234;
(68) an amino acid sequence at least 99% identical to amino acids 22-134 of SEQ ID NO: 243 and an amino acid sequence at least 99% identical to amino acids 17-130 of SEQ ID NO: 244;
(69) an amino acid sequence at least 99% identical to amino acids 20-125 of SEQ ID NO: 253 and an amino acid sequence at least 99% identical to amino acids 27-134 of SEQ ID NO: 254;
(70) an amino acid sequence at least 99% identical to amino acids 21-135 of SEQ ID NO: 263 and an amino acid sequence at least 99% identical to amino acids 22-138 of SEQ ID NO: 264;
(71) an amino acid sequence at least 99% identical to amino acids 23-136 of SEQ ID NO: 273 and an amino acid sequence at least 99% identical to amino acids 22-141 of SEQ ID NO: 274;
(72) an amino acid sequence at least 99% identical to amino acids 23-136 of SEQ ID NO: 283 and an amino acid sequence at least 99% identical to amino acids 17-131 of SEQ ID NO: 284;
(73) an amino acid sequence at least 99% identical to amino acids 22-135 of SEQ ID NO: 293 and an amino acid sequence at least 99% identical to amino acids 22-134 of SEQ ID NO: 294;
(74) an amino acid sequence at least 99% identical to amino acids 22-134 of SEQ ID NO: 303 and an amino acid sequence at least 99% identical to amino acids 22-133 of SEQ ID NO: 304;
(75) an amino acid sequence at least 99% identical to amino acids 23-134 of SEQ ID NO: 313 and an amino acid sequence at least 99% identical to amino acids 22-134 of SEQ ID NO: 314;
(76) an amino acid sequence at least 99% identical to amino acids 22-136 of SEQ ID NO: 323 and an amino acid sequence at least 99% identical to amino acids 22-135 of SEQ ID NO: 324;
(77) an amino acid sequence at least 99% identical to amino acids 19-125 of SEQ ID NO: 333 and an amino acid sequence at least 99% identical to amino acids 22-133 of SEQ ID NO: 334;
(78) an amino acid sequence at least 99% identical to amino acids 22-130 of SEQ ID NO: 343 and an amino acid sequence at least 99% identical to amino acids 22-132 of SEQ ID NO: 344;
(79) an amino acid sequence at least 99% identical to amino acids 22-130 of SEQ ID NO: 353 and an amino acid sequence at least 99% identical to amino acids 22-134 of SEQ ID NO: 354;
(80) an amino acid sequence at least 99% identical to amino acids 22-130 of SEQ ID NO: 363 and an amino acid sequence at least 99% identical to amino acids 22-134 of SEQ ID NO: 364;
(81) an amino acid sequence at least 99% identical to amino acids 21-133 of SEQ ID NO: 373 and an amino acid sequence at least 99% identical to amino acids 22-125 of SEQ ID NO: 374;
(82) an amino acid sequence at least 99% identical to amino acids 20-128 of SEQ ID NO: 383 and an amino acid sequence at least 99% identical to amino acids 25-132 of SEQ ID NO: 384;
(83) an amino acid sequence at least 99% identical to amino acids 22-131 of SEQ ID NO: 393 and an amino acid sequence at least 99% identical to amino acids 22-134 of SEQ ID NO: 394;
(84) an amino acid sequence at least 99% identical to amino acids 21-134 of SEQ ID NO: 403 and an amino acid sequence at least 99% identical to amino acids 22-134 of SEQ ID NO: 404;
(85) an amino acid sequence at least 99% identical to amino acids 21-134 of SEQ ID NO: 413 and an amino acid sequence at least 99% identical to amino acids 22-134 of SEQ ID NO: 414;
(86) an amino acid sequence at least 99% identical to amino acids 21-134 of SEQ ID NO: 423 and an amino acid sequence at least 99% identical to amino acids 22-134 of SEQ ID NO: 424;
(87) an amino acid sequence at least 99% identical to amino acids 21-134 of SEQ ID NO: 433 and an amino acid sequence at least 99% identical to amino acids 22-134 of SEQ ID NO: 434;
(88) an amino acid sequence at least 99% identical to amino acids 21-133 of SEQ ID NO: 443 and an amino acid sequence at least 99% identical to amino acids 22-130 of SEQ ID NO: 444;
(89) an amino acid sequence at least 99% identical to amino acids 21-133 of SEQ ID NO: 453 and an amino acid sequence at least 99% identical to amino acids 22-130 of SEQ ID NO: 454;
(90) an amino acid sequence at least 99% identical to amino acids 21-131 of SEQ ID NO: 463 and an amino acid sequence at least 99% identical to amino acids 22-140 of SEQ ID NO: 464;
(91) an amino acid sequence at least 99% identical to amino acids 21-133 of SEQ ID NO: 483 and an amino acid sequence at least 99% identical to amino acids 22-133 of SEQ ID NO: 484; or
(92) an amino acid sequence at least 99% identical to amino acids 23-134 of SEQ ID NO: 493 and an amino acid sequence at least 99% identical to amino acids 22-132 of SEQ ID NO: 494.

12. The polypeptide of claim 10, wherein the functional portion comprises the amino acid sequences of:
(1) both of SEQ ID NOs: 33-34;
(2) both of SEQ ID NOs: 43-44;
(3) both of SEQ ID NOs: 53-54;
(4) both of SEQ ID NOs: 63-64;
(5) both of SEQ ID NOs: 73-74;
(6) both of SEQ ID NOs: 83-84;
(7) both of SEQ ID NOs: 93-94;
(8) both of SEQ ID NOs: 103-104;
(9) both of SEQ ID NOs: 113-114;
(10) both of SEQ ID NOs: 123-124;
(11) both of SEQ ID NOs: 133-134;
(12) both of SEQ ID NOs: 143-144;
(13) both of SEQ ID NOs: 153-154;
(14) both of SEQ ID NOs: 163-164;
(15) both of SEQ ID NOs: 173-174;
(16) both of SEQ ID NOs: 183-184;
(17) both of SEQ ID NOs: 193-194;
(18) both of SEQ ID NOs: 203-204;
(19) both of SEQ ID NOs: 213-214;
(20) both of SEQ ID NOs: 223-224;
(21) both of SEQ ID NOs: 233-234;
(22) both of SEQ ID NOs: 243-244;
(23) both of SEQ ID NOs: 253-254;
(24) both of SEQ ID NOs: 263-264;
(25) both of SEQ ID NOs: 273-274;
(26) both of SEQ ID NOs: 283-284;
(27) both of SEQ ID NOs: 293-294;
(28) both of SEQ ID NOs: 303-304;
(29) both of SEQ ID NOs: 313-314;
(30) both of SEQ ID NOs: 323-324;
(31) both of SEQ ID NOs: 333-334;
(32) both of SEQ ID NOs: 343-344;
(33) both of SEQ ID NOs: 353-354;
(34) both of SEQ ID NOs: 363-364;
(35) both of SEQ ID NOs: 373-374;
(36) both of SEQ ID NOs: 383-384;
(37) both of SEQ ID NOs: 393-394;
(38) both of SEQ ID NOs: 403-404;
(39) both of SEQ ID NOs: 413-414;
(40) both of SEQ ID NOs: 423-424;
(41) both of SEQ ID NOs: 433-434;
(42) both of SEQ ID NOs: 443-444;
(43) both of SEQ ID NOs: 453-454;
(44) both of SEQ ID NOs: 463-464;
(45) both of SEQ ID NOs: 483-484;
(46) both of SEQ ID NOs: 493-494;
(47) amino acids 21-130 of SEQ ID NO: 33 and amino acids 22-131 of SEQ ID NO: 34;
(48) amino acids 22-135 of SEQ ID NO: 43 and amino acids 20-132 of SEQ ID NO: 44;
(49) amino acids 19-127 of SEQ ID NO: 53 and amino acids 24-134 of SEQ ID NO: 54;
(50) amino acids 21-131 of SEQ ID NO: 63 and amino acids 22-132 of SEQ ID NO: 64;
(51) amino acids 21-131 of SEQ ID NO: 73 and amino acids 22-134 of SEQ ID NO: 74;
(52) amino acids 22-137 of SEQ ID NO: 83 and amino acids 22-133 of SEQ ID NO: 84;
(53) amino acids 22-131 of SEQ ID NO: 93 and amino acids 22-134 of SEQ ID NO: 94;
(54) amino acids 21-133 of SEQ ID NO: 103 and amino acids 22-129 of SEQ ID NO: 104;
(55) amino acids 19-126 of SEQ ID NO: 113 and amino acids 22-134 of SEQ ID NO: 114;
(56) amino acids 19-128 of SEQ ID NO: 123 and amino acids 22-134 of SEQ ID NO: 124;
(57) amino acids 19-128 of SEQ ID NO: 133 and amino acids 22-134 of SEQ ID NO: 134;
(58) amino acids 21-130 of SEQ ID NO: 143 and amino acids 22-131 of SEQ ID NO: 144;
(59) amino acids 20-128 of SEQ ID NO: 153 and amino acids 22-132 of SEQ ID NO: 154;
(60) amino acids 21-135 of SEQ ID NO: 163 and amino acids 22-132 of SEQ ID NO: 164;
(61) amino acids 21-133 of SEQ ID NO: 173 and amino acids 27-131 of SEQ ID NO: 174;
(62) amino acids 19-129 of SEQ ID NO: 183 and amino acids 27-132 of SEQ ID NO: 184;
(63) amino acids 22-134 of SEQ ID NO: 193 and amino acids 20-131 of SEQ ID NO: 194;
(64) amino acids 21-135 of SEQ ID NO: 203 and amino acids 22-134 of SEQ ID NO: 204;
(65) amino acids 22-136 of SEQ ID NO: 213 and amino acids 22-134 of SEQ ID NO: 214;
(66) amino acids 22-136 of SEQ ID NO: 223 and amino acids 22-134 of SEQ ID NO: 224;
(67) amino acids 22-134 of SEQ ID NO: 233 and amino acids 22-140 of SEQ ID NO: 234;
(68) amino acids 22-134 of SEQ ID NO: 243 and amino acids 17-130 of SEQ ID NO: 244;
(69) amino acids 20-125 of SEQ ID NO: 253 and amino acids 27-134 of SEQ ID NO: 254;
(70) amino acids 21-135 of SEQ ID NO: 263 and amino acids 22-138 of SEQ ID NO: 264;
(71) amino acids 23-136 of SEQ ID NO: 273 and amino acids 22-141 of SEQ ID NO: 274;
(72) amino acids 23-136 of SEQ ID NO: 283 and amino acids 17-131 of SEQ ID NO: 284;
(73) amino acids 22-135 of SEQ ID NO: 293 and amino acids 22-134 of SEQ ID NO: 294;
(74) amino acids 22-134 of SEQ ID NO: 303 and amino acids 22-133 of SEQ ID NO: 304;
(75) amino acids 23-134 of SEQ ID NO: 313 and amino acids 22-134 of SEQ ID NO: 314;
(76) amino acids 22-136 of SEQ ID NO: 323 and amino acids 22-135 of SEQ ID NO: 324;
(77) amino acids 19-125 of SEQ ID NO: 333 and amino acids 22-133 of SEQ ID NO: 334;
(78) amino acids 22-130 of SEQ ID NO: 343 and amino acids 22-132 of SEQ ID NO: 344;
(79) amino acids 22-130 of SEQ ID NO: 353 and amino acids 22-134 of SEQ ID NO: 354;
(80) amino acids 22-130 of SEQ ID NO: 363 and amino acids 22-134 of SEQ ID NO: 364;
(81) amino acids 21-133 of SEQ ID NO: 373 and amino acids 22-125 of SEQ ID NO: 374;
(82) amino acids 20-128 of SEQ ID NO: 383 and amino acids 25-132 of SEQ ID NO: 384;
(83) amino acids 22-131 of SEQ ID NO: 393 and amino acids 22-134 of SEQ ID NO: 394;
(84) amino acids 21-134 of SEQ ID NO: 403 and amino acids 22-134 of SEQ ID NO: 404;
(85) amino acids 21-134 of SEQ ID NO: 413 and amino acids 22-134 of SEQ ID NO: 414;
(86) amino acids 21-134 of SEQ ID NO: 423 and amino acids 22-134 of SEQ ID NO: 424;
(87) amino acids 21-134 of SEQ ID NO: 433 and amino acids 22-134 of SEQ ID NO: 434;
(88) amino acids 21-133 of SEQ ID NO: 443 and amino acids 22-130 of SEQ ID NO: 444;

(89) amino acids 21-133 of SEQ ID NO: 453 and amino acids 22-130 of SEQ ID NO: 454;
(90) amino acids 21-131 of SEQ ID NO: 463 and amino acids 22-140 of SEQ ID NO: 464;
(91) amino acids 21-133 of SEQ ID NO: 483 and amino acids 22-133 of SEQ ID NO: 484; or
(92) amino acids 23-134 of SEQ ID NO: 493 and amino acids 22-132 of SEQ ID NO: 494.

13. The polypeptide of claim 10, wherein the functional portion comprises:

(1) an amino acid sequence at least 99% identical to SEQ ID NO: 35 and an amino acid sequence at least 99% identical to SEQ ID NO: 36;
(2) an amino acid sequence at least 99% identical to SEQ ID NO: 45 and an amino acid sequence at least 99% identical to SEQ ID NO:46;
(3) an amino acid sequence at least 99% identical to SEQ ID NO: 55 and an amino acid sequence at least 99% identical to SEQ ID NO:56;
(4) an amino acid sequence at least 99% identical to SEQ ID NO: 65 and an amino acid sequence at least 99% identical to SEQ ID NO:66;
(5) an amino acid sequence at least 99% identical to SEQ ID NO: 75 and an amino acid sequence at least 99% identical to SEQ ID NO:76;
(6) an amino acid sequence at least 99% identical to SEQ ID NO: 85 and an amino acid sequence at least 99% identical to SEQ ID NO:86;
(7) an amino acid sequence at least 99% identical to SEQ ID NO: 95 and an amino acid sequence at least 99% identical to SEQ ID NO:96;
(8) an amino acid sequence at least 99% identical to SEQ ID NO: 105 and an amino acid sequence at least 99% identical to SEQ ID NO:106;
(9) an amino acid sequence at least 99% identical to SEQ ID NO: 115 and an amino acid sequence at least 99% identical to SEQ ID NO:116;
(10) an amino acid sequence at least 99% identical to SEQ ID NO: 125 and an amino acid sequence at least 99% identical to SEQ ID NO:126;
(11) an amino acid sequence at least 99% identical to SEQ ID NO: 135 and an amino acid sequence at least 99% identical to SEQ ID NO:136;
(12) an amino acid sequence at least 99% identical to SEQ ID NO: 145 and an amino acid sequence at least 99% identical to SEQ ID NO:146;
(13) an amino acid sequence at least 99% identical to SEQ ID NO: 155 and an amino acid sequence at least 99% identical to SEQ ID NO:156;
(14) an amino acid sequence at least 99% identical to SEQ ID NO: 165 and an amino acid sequence at least 99% identical to SEQ ID NO:166;
(15) an amino acid sequence at least 99% identical to SEQ ID NO: 175 and an amino acid sequence at least 99% identical to SEQ ID NO:176;
(16) an amino acid sequence at least 99% identical to SEQ ID NO: 185 and an amino acid sequence at least 99% identical to SEQ ID NO:186;
(17) an amino acid sequence at least 99% identical to SEQ ID NO: 195 and an amino acid sequence at least 99% identical to SEQ ID NO:196;
(18) an amino acid sequence at least 99% identical to SEQ ID NO: 205 and an amino acid sequence at least 99% identical to SEQ ID NO:206;
(19) an amino acid sequence at least 99% identical to SEQ ID NO: 215 and an amino acid sequence at least 99% identical to SEQ ID NO:216;
(20) an amino acid sequence at least 99% identical to SEQ ID NO: 225 and an amino acid sequence at least 99% identical to SEQ ID NO:226;
(21) an amino acid sequence at least 99% identical to SEQ ID NO: 235 and an amino acid sequence at least 99% identical to SEQ ID NO:236;
(22) an amino acid sequence at least 99% identical to SEQ ID NO: 245 and an amino acid sequence at least 99% identical to SEQ ID NO:246;
(23) an amino acid sequence at least 99% identical to SEQ ID NO: 255 and an amino acid sequence at least 99% identical to SEQ ID NO:256;
(24) an amino acid sequence at least 99% identical to SEQ ID NO: 265 and an amino acid sequence at least 99% identical to SEQ ID NO:266;
(25) an amino acid sequence at least 99% identical to SEQ ID NO: 275 and an amino acid sequence at least 99% identical to SEQ ID NO:276;
(26) an amino acid sequence at least 99% identical to SEQ ID NO: 285 and an amino acid sequence at least 99% identical to SEQ ID NO:286;
(27) an amino acid sequence at least 99% identical to SEQ ID NO: 295 and an amino acid sequence at least 99% identical to SEQ ID NO:296;
(28) an amino acid sequence at least 99% identical to SEQ ID NO: 305 and an amino acid sequence at least 99% identical to SEQ ID NO:306;
(29) an amino acid sequence at least 99% identical to SEQ ID NO: 315 and an amino acid sequence at least 99% identical to SEQ ID NO:316;
(30) an amino acid sequence at least 99% identical to SEQ ID NO: 325 and an amino acid sequence at least 99% identical to SEQ ID NO:326;
(31) an amino acid sequence at least 99% identical to SEQ ID NO: 335 and an amino acid sequence at least 99% identical to SEQ ID NO:336;
(32) an amino acid sequence at least 99% identical to SEQ ID NO: 345 and an amino acid sequence at least 99% identical to SEQ ID NO:346;
(33) an amino acid sequence at least 99% identical to SEQ ID NO: 355 and an amino acid sequence at least 99% identical to SEQ ID NO:356;
(34) an amino acid sequence at least 99% identical to SEQ ID NO: 365 and an amino acid sequence at least 99% identical to SEQ ID NO:366;
(35) an amino acid sequence at least 99% identical to SEQ ID NO: 375 and an amino acid sequence at least 99% identical to SEQ ID NO:376;
(36) an amino acid sequence at least 99% identical to SEQ ID NO: 385 and an amino acid sequence at least 99% identical to SEQ ID NO:386;
(37) an amino acid sequence at least 99% identical to SEQ ID NO: 395 and an amino acid sequence at least 99% identical to SEQ ID NO:396;
(38) an amino acid sequence at least 99% identical to SEQ ID NO: 405 and an amino acid sequence at least 99% identical to SEQ ID NO:406;
(39) an amino acid sequence at least 99% identical to SEQ ID NO: 415 and an amino acid sequence at least 99% identical to SEQ ID NO:416;
(40) an amino acid sequence at least 99% identical to SEQ ID NO: 425 and an amino acid sequence at least 99% identical to SEQ ID NO:426;
(41) an amino acid sequence at least 99% identical to SEQ ID NO: 435 and an amino acid sequence at least 99% identical to SEQ ID NO:436;

(42) an amino acid sequence at least 99% identical to SEQ ID NO: 445 and an amino acid sequence at least 99% identical to SEQ ID NO:446;
(43) an amino acid sequence at least 99% identical to SEQ ID NO: 455 and an amino acid sequence at least 99% identical to SEQ ID NO:456;
(44) an amino acid sequence at least 99% identical to SEQ ID NO: 465 and an amino acid sequence at least 99% identical to SEQ ID NO:466;
(45) an amino acid sequence at least 99% identical to SEQ ID NO: 485 and an amino acid sequence at least 99% identical to SEQ ID NO:486;
(46) an amino acid sequence at least 99% identical to SEQ ID NO: 495 and an amino acid sequence at least 99% identical to SEQ ID NO:496;
(47) an amino acid sequence at least 99% identical to amino acids 21-267 of SEQ ID NO: 35 and an amino acid sequence at least 99% identical to amino acids 22-304 of SEQ ID NO: 36;
(48) an amino acid sequence at least 99% identical to amino acids 22-272 of SEQ ID NO: 45 and an amino acid sequence at least 99% identical to amino acids 20-305 of SEQ ID NO: 46;
(49) an amino acid sequence at least 99% identical to amino acids 19-264 of SEQ ID NO: 55 and an amino acid sequence at least 99% identical to amino acids 24-307 of SEQ ID NO: 56;
(50) an amino acid sequence at least 99% identical to amino acids 21-268 of SEQ ID NO: 65 and an amino acid sequence at least 99% identical to amino acids 22-305 of SEQ ID NO: 66;
(51) an amino acid sequence at least 99% identical to amino acids 21-268 of SEQ ID NO: 75 and an amino acid sequence at least 99% identical to amino acids 22-307 of SEQ ID NO: 76;
(52) an amino acid sequence at least 99% identical to amino acids 22-274 of SEQ ID NO: 85 and an amino acid sequence at least 99% identical to amino acids 22-306 of SEQ ID NO: 86;
(53) an amino acid sequence at least 99% identical to amino acids 22-268 of SEQ ID NO: 95 and an amino acid sequence at least 99% identical to amino acids 22-307 of SEQ ID NO: 96;
(54) an amino acid sequence at least 99% identical to amino acids 21-270 of SEQ ID NO: 105 and an amino acid sequence at least 99% identical to amino acids 22-302 of SEQ ID NO: 106;
(55) an amino acid sequence at least 99% identical to amino acids 19-263 of SEQ ID NO: 115 and an amino acid sequence at least 99% identical to amino acids 22-307 of SEQ ID NO: 116;
(56) an amino acid sequence at least 99% identical to amino acids 19-265 of SEQ ID NO: 125 and an amino acid sequence at least 99% identical to amino acids 22-307 of SEQ ID NO: 126;
(57) an amino acid sequence at least 99% identical to amino acids 19-265 of SEQ ID NO: 135 and an amino acid sequence at least 99% identical to amino acids 22-307 of SEQ ID NO: 136;
(58) an amino acid sequence at least 99% identical to amino acids 21-267 of SEQ ID NO: 145 and an amino acid sequence at least 99% identical to amino acids 22-304 of SEQ ID NO:146;
(59) an amino acid sequence at least 99% identical to amino acids 20-265 of SEQ ID NO: 155 and an amino acid sequence at least 99% identical to amino acids 22-305 of SEQ ID NO: 156;
(60) an amino acid sequence at least 99% identical to amino acids 21-272 of SEQ ID NO: 165 and an amino acid sequence at least 99% identical to amino acids 22-305 of SEQ ID NO: 166;
(61) an amino acid sequence at least 99% identical to amino acids 21-270 of SEQ ID NO: 175 and an amino acid sequence at least 99% identical to amino acids 27-304 of SEQ ID NO: 176;
(62) an amino acid sequence at least 99% identical to amino acids 19-266 of SEQ ID NO: 185 and an amino acid sequence at least 99% identical to amino acids 27-305 of SEQ ID NO: 186;
(63) an amino acid sequence at least 99% identical to amino acids 22-271 of SEQ ID NO: 195 and an amino acid sequence at least 99% identical to amino acids 20-304 of SEQ ID NO: 196;
(64) an amino acid sequence at least 99% identical to amino acids 21-272 of SEQ ID NO: 205 and an amino acid sequence at least 99% identical to amino acids 22-307 of SEQ ID NO: 206;
(65) an amino acid sequence at least 99% identical to amino acids 22-273 of SEQ ID NO: 215 and an amino acid sequence at least 99% identical to amino acids 22-307 of SEQ ID NO: 216;
(66) an amino acid sequence at least 99% identical to amino acids 22-273 of SEQ ID NO: 225 and an amino acid sequence at least 99% identical to amino acids 22-307 of SEQ ID NO: 226;
(67) an amino acid sequence at least 99% identical to amino acids 22-271 of SEQ ID NO: 235 and an amino acid sequence at least 99% identical to amino acids 22-313 of SEQ ID NO: 236;
(68) an amino acid sequence at least 99% identical to amino acids 22-271 of SEQ ID NO: 245 and an amino acid sequence at least 99% identical to amino acids 17-303 of SEQ ID NO: 246;
(69) an amino acid sequence at least 99% identical to amino acids 20-262 of SEQ ID NO: 255 and an amino acid sequence at least 99% identical to amino acids 27-307 of SEQ ID NO: 256;
(70) an amino acid sequence at least 99% identical to amino acids 21-272 of SEQ ID NO: 265 and an amino acid sequence at least 99% identical to amino acids 22-311 of SEQ ID NO: 266;
(71) an amino acid sequence at least 99% identical to amino acids 23-273 of SEQ ID NO: 275 and an amino acid sequence at least 99% identical to amino acids 22-314 of SEQ ID NO: 276;
(72) an amino acid sequence at least 99% identical to amino acids 23-273 of SEQ ID NO: 285 and an amino acid sequence at least 99% identical to amino acids 17-304 of SEQ ID NO: 286;
(73) an amino acid sequence at least 99% identical to amino acids 22-272 of SEQ ID NO: 295 and an amino acid sequence at least 99% identical to amino acids 22-307 of SEQ ID NO: 296;
(74) an amino acid sequence at least 99% identical to amino acids 22-271 of SEQ ID NO: 305 and an amino acid sequence at least 99% identical to amino acids 22-306 of SEQ ID NO: 306;
(75) an amino acid sequence at least 99% identical to amino acids 23-271 of SEQ ID NO: 315 and an amino acid sequence at least 99% identical to amino acids 22-307 of SEQ ID NO: 316;
(76) an amino acid sequence at least 99% identical to amino acids 22-273 of SEQ ID NO: 325 and an amino acid sequence at least 99% identical to amino acids 22-308 of SEQ ID NO: 326;

(77) an amino acid sequence at least 99% identical to amino acids 19-262 of SEQ ID NO: 335 and an amino acid sequence at least 99% identical to amino acids 22-306 of SEQ ID NO: 336;

(78) an amino acid sequence at least 99% identical to amino acids 22-267 of SEQ ID NO: 345 and an amino acid sequence at least 99% identical to amino acids 22-305 of SEQ ID NO: 346;

(79) an amino acid sequence at least 99% identical to amino acids 22-267 of SEQ ID NO: 355 and an amino acid sequence at least 99% identical to amino acids 22-307 of SEQ ID NO: 356;

(80) an amino acid sequence at least 99% identical to amino acids 22-267 of SEQ ID NO: 365 and an amino acid sequence at least 99% identical to amino acids 22-307 of SEQ ID NO: 366;

(81) an amino acid sequence at least 99% identical to amino acids 21-270 of SEQ ID NO: 375 and an amino acid sequence at least 99% identical to amino acids 22-298 of SEQ ID NO: 376;

(82) an amino acid sequence at least 99% identical to amino acids 20-265 of SEQ ID NO: 385 and an amino acid sequence at least 99% identical to amino acids 25-305 of SEQ ID NO: 386;

(83) an amino acid sequence at least 99% identical to amino acids 22-268 of SEQ ID NO: 395 and an amino acid sequence at least 99% identical to amino acids 22-307 of SEQ ID NO: 396;

(84) an amino acid sequence at least 99% identical to amino acids 21-271 of SEQ ID NO: 405 and an amino acid sequence at least 99% identical to amino acids 22-307 of SEQ ID NO: 406;

(85) an amino acid sequence at least 99% identical to amino acids 21-271 of SEQ ID NO: 415 and an amino acid sequence at least 99% identical to amino acids 22-307 of SEQ ID NO: 416;

(86) an amino acid sequence at least 99% identical to amino acids 21-271 of SEQ ID NO: 425 and an amino acid sequence at least 99% identical to amino acids 22-307 of SEQ ID NO: 426;

(87) an amino acid sequence at least 99% identical to amino acids 21-271 of SEQ ID NO: 435 and an amino acid sequence at least 99% identical to amino acids 22-307 of SEQ ID NO: 436;

(88) an amino acid sequence at least 99% identical to amino acids 21-270 of SEQ ID NO: 445 and an amino acid sequence at least 99% identical to amino acids 22-303 of SEQ ID NO: 446;

(89) an amino acid sequence at least 99% identical to amino acids 21-270 of SEQ ID NO: 455 and an amino acid sequence at least 99% identical to amino acids 22-303 of SEQ ID NO: 456;

(90) an amino acid sequence at least 99% identical to amino acids 21-268 of SEQ ID NO: 465 and an amino acid sequence at least 99% identical to amino acids 22-313 of SEQ ID NO: 466;

(91) an amino acid sequence at least 99% identical to amino acids 21-270 of SEQ ID NO: 485 and an amino acid sequence at least 99% identical to amino acids 22-306 of SEQ ID NO: 486; or

(92) an amino acid sequence at least 99% identical to amino acids 23-271 of SEQ ID NO: 495 and an amino acid sequence at least 99% identical to amino acids 22-305 of SEQ ID NO: 496.

14. The polypeptide of claim 10, wherein the functional portion comprises the amino acid sequences of:
(1) both of SEQ ID NOs: 35-36;
(2) both of SEQ ID NOs: 45-46;
(3) both of SEQ ID NOs: 55-56;
(4) both of SEQ ID NOs: 65-66;
(5) both of SEQ ID NOs: 75-76;
(6) both of SEQ ID NOs: 85-86;
(7) both of SEQ ID NOs: 95-96;
(8) both of SEQ ID NOs: 105-106;
(9) both of SEQ ID NOs: 115-116;
(10) both of SEQ ID NOs: 125-126;
(11) both of SEQ ID NOs: 135-136;
(12) both of SEQ ID NOs: 145-146;
(13) both of SEQ ID NOs: 155-156;
(14) both of SEQ ID NOs: 165-166;
(15) both of SEQ ID NOs: 175-176;
(16) both of SEQ ID NOs: 185-186;
(17) both of SEQ ID NOs: 195-196;
(18) both of SEQ ID NOs: 205-206;
(19) both of SEQ ID NOs: 215-216;
(20) both of SEQ ID NOs: 225-226;
(21) both of SEQ ID NOs: 235-236;
(22) both of SEQ ID NOs: 245-246;
(23) both of SEQ ID NOs: 255-256;
(24) both of SEQ ID NOs: 265-266;
(25) both of SEQ ID NOs: 275-276;
(26) both of SEQ ID NOs: 285-286;
(27) both of SEQ ID NOs: 295-296;
(28) both of SEQ ID NOs: 305-306;
(29) both of SEQ ID NOs: 315-316;
(30) both of SEQ ID NOs: 325-326;
(31) both of SEQ ID NOs: 335-336;
(32) both of SEQ ID NOs: 345-346;
(33) both of SEQ ID NOs: 355-356;
(34) both of SEQ ID NOs: 365-366;
(35) both of SEQ ID NOs: 375-376;
(36) both of SEQ ID NOs: 385-386;
(37) both of SEQ ID NOs: 395-396;
(38) both of SEQ ID NOs: 405-406;
(39) both of SEQ ID NOs: 415-416;
(40) both of SEQ ID NOs: 425-426;
(41) both of SEQ ID NOs: 435-436;
(42) both of SEQ ID NOs: 445-446;
(43) both of SEQ ID NOs: 455-456;
(44) both of SEQ ID NOs: 465-466;
(45) both of SEQ ID NOs: 485-486;
(46) both of SEQ ID NOs: 495-496;
(47) amino acids 21-267 of SEQ ID NO: 35 and amino acids 22-304 of SEQ ID NO: 36;
(48) amino acids 22-272 of SEQ ID NO: 45 and amino acids 20-305 of SEQ ID NO: 46;
(49) amino acids 19-264 of SEQ ID NO: 55 and amino acids 24-307 of SEQ ID NO: 56;
(50) amino acids 21-268 of SEQ ID NO: 65 and amino acids 22-305 of SEQ ID NO: 66;
(51) amino acids 21-268 of SEQ ID NO: 75 and amino acids 22-307 of SEQ ID NO: 76;
(52) amino acids 22-274 of SEQ ID NO: 85 and amino acids 22-306 of SEQ ID NO: 86;
(53) amino acids 22-268 of SEQ ID NO: 95 and amino acids 22-307 of SEQ ID NO: 96;
(54) amino acids 21-270 of SEQ ID NO: 105 and amino acids 22-302 of SEQ ID NO: 106;
(55) amino acids 19-263 of SEQ ID NO: 115 and amino acids 22-307 of SEQ ID NO: 116;

(56) amino acids 19-265 of SEQ ID NO: 125 and amino acids 22-307 of SEQ ID NO: 126;
(57) amino acids 19-265 of SEQ ID NO: 135 and amino acids 22-307 of SEQ ID NO: 136;
(58) amino acids 21-267 of SEQ ID NO: 145 and amino acids 22-304 of SEQ ID NO: 146;
(59) amino acids 20-265 of SEQ ID NO: 155 and amino acids 22-305 of SEQ ID NO: 156;
(60) amino acids 21-272 of SEQ ID NO: 165 and amino acids 22-305 of SEQ ID NO: 166;
(61) amino acids 21-270 of SEQ ID NO: 175 and amino acids 27-304 of SEQ ID NO: 176;
(62) amino acids 19-266 of SEQ ID NO: 185 and amino acids 27-305 of SEQ ID NO: 186;
(63) amino acids 22-271 of SEQ ID NO: 195 and amino acids 20-304 of SEQ ID NO: 196;
(64) amino acids 21-272 of SEQ ID NO: 205 and amino acids 22-307 of SEQ ID NO: 206;
(65) amino acids 22-273 of SEQ ID NO: 215 and amino acids 22-307 of SEQ ID NO: 216;
(66) amino acids 22-273 of SEQ ID NO: 225 and amino acids 22-307 of SEQ ID NO: 226;
(67) amino acids 22-271 of SEQ ID NO: 235 and amino acids 22-313 of SEQ ID NO: 236;
(68) amino acids 22-271 of SEQ ID NO: 245 and amino acids 17-303 of SEQ ID NO: 246;
(69) amino acids 20-262 of SEQ ID NO: 255 and amino acids 27-307 of SEQ ID NO: 256;
(70) amino acids 21-272 of SEQ ID NO: 265 and amino acids 22-311 of SEQ ID NO: 266;
(71) amino acids 23-273 of SEQ ID NO: 275 and amino acids 22-314 of SEQ ID NO: 276;
(72) amino acids 23-273 of SEQ ID NO: 285 and amino acids 17-304 of SEQ ID NO: 286;
(73) amino acids 22-272 of SEQ ID NO: 295 and amino acids 22-307 of SEQ ID NO: 296;
(74) amino acids 22-271 of SEQ ID NO: 305 and amino acids 22-306 of SEQ ID NO: 306;
(75) amino acids 23-271 of SEQ ID NO: 315 and amino acids 22-307 of SEQ ID NO: 316;
(76) amino acids 22-273 of SEQ ID NO: 325 and amino acids 22-308 of SEQ ID NO: 326;
(77) amino acids 19-262 of SEQ ID NO: 335 and amino acids 22-306 of SEQ ID NO: 336;
(78) amino acids 22-267 of SEQ ID NO: 345 and amino acids 22-305 of SEQ ID NO: 346;
(79) amino acids 22-267 of SEQ ID NO: 355 and amino acids 22-307 of SEQ ID NO: 356;
(80) amino acids 22-267 of SEQ ID NO: 365 and amino acids 22-307 of SEQ ID NO: 366;
(81) amino acids 21-270 of SEQ ID NO: 375 and amino acids 22-298 of SEQ ID NO: 376;
(82) amino acids 20-265 of SEQ ID NO: 385 and amino acids 25-305 of SEQ ID NO: 386;
(83) amino acids 22-268 of SEQ ID NO: 395 and amino acids 22-307 of SEQ ID NO: 396;
(84) amino acids 21-271 of SEQ ID NO: 405 and amino acids 22-307 of SEQ ID NO: 406;
(85) amino acids 21-271 of SEQ ID NO: 415 and amino acids 22-307 of SEQ ID NO: 416;
(86) amino acids 21-271 of SEQ ID NO: 425 and amino acids 22-307 of SEQ ID NO: 426;
(87) amino acids 21-271 of SEQ ID NO: 435 and amino acids 22-307 of SEQ ID NO: 436;
(88) amino acids 21-270 of SEQ ID NO: 445 and amino acids 22-303 of SEQ ID NO: 446;
(89) amino acids 21-270 of SEQ ID NO: 455 and amino acids 22-303 of SEQ ID NO: 456;
(90) amino acids 21-268 of SEQ ID NO: 465 and amino acids 22-313 of SEQ ID NO: 466;
(91) amino acids 21-270 of SEQ ID NO: 485 and amino acids 22-306 of SEQ ID NO: 486; or
(92) amino acids 23-271 of SEQ ID NO: 495 and amino acids 22-305 of SEQ ID NO: 496.

15. An isolated or purified protein having antigenic specificity for mutated human p53, wherein the mutated human p53 has one of the following human p53 mutations: R175H, Y220C, G245S, R248Q, or R248W, wherein the human p53 mutations are defined by reference to SEQ ID NO: 1, and wherein the protein comprises an amino acid sequence at least 97% identical to SEQ ID NO: 23 or 24, an amino acid sequence at least 97% identical to SEQ ID NO: 25, and:

(1) a first polypeptide chain comprising the amino acid sequences of all of SEQ ID NOs: 27-29 and a second polypeptide chain comprising the amino acid sequences of all of SEQ ID NOs: 30-32;
(2) a first polypeptide chain comprising the amino acid sequences of all of SEQ ID NOs: 37-39 and a second polypeptide chain comprising the amino acid sequences of all of SEQ ID NOs: 40-42;
(3) a first polypeptide chain comprising the amino acid sequences of all of SEQ ID NOs: 47-49 and a second polypeptide chain comprising the amino acid sequences of all of SEQ ID NOs: 50-52;
(4) a first polypeptide chain comprising the amino acid sequences of all of SEQ ID NOs: 57-59 and a second polypeptide chain comprising the amino acid sequences of all of SEQ ID NOs: 60-62;
(5) a first polypeptide chain comprising the amino acid sequences of all of SEQ ID NOs: 67-69 and a second polypeptide chain comprising the amino acid sequences of all of SEQ ID NOs: 70-72;
(6) a first polypeptide chain comprising the amino acid sequences of all of SEQ ID NOs: 77-79 and a second polypeptide chain comprising the amino acid sequences of all of SEQ ID NOs: 80-82;
(7) a first polypeptide chain comprising the amino acid sequences of all of SEQ ID NOs: 87-89 and a second polypeptide chain comprising the amino acid sequences of all of SEQ ID NOs: 90-92;
(8) a first polypeptide chain comprising the amino acid sequences of all of SEQ ID NOs: 97-99 and a second polypeptide chain comprising the amino acid sequences of all of SEQ ID NOs: 100-102;
(9) a first polypeptide chain comprising the amino acid sequences of all of SEQ ID NOs: 107-109 and a second polypeptide chain comprising the amino acid sequences of all of SEQ ID NOs: 110-112;
(10) a first polypeptide chain comprising the amino acid sequences of all of SEQ ID NOs: 117-119 and a second polypeptide chain comprising the amino acid sequences of all of SEQ ID NOs: 120-122;
(11) a first polypeptide chain comprising the amino acid sequences of all of SEQ ID NOs: 127-129 and a second polypeptide chain comprising the amino acid sequences of all of SEQ ID NOs: 130-132;
(12) a first polypeptide chain comprising the amino acid sequences of all of SEQ ID NOs: 137-139 and a second polypeptide chain comprising the amino acid sequences of all of SEQ ID NOs: 140-142;
(13) a first polypeptide chain comprising the amino acid sequences of all of SEQ ID NOs: 147-149 and a second polypeptide chain comprising the amino acid sequences of all of SEQ ID NOs: 150-152;

(14) a first polypeptide chain comprising the amino acid sequences of all of SEQ ID NOs: 157-159 and a second polypeptide chain comprising the amino acid sequences of all of SEQ ID NOs: 160-162;

(15) a first polypeptide chain comprising the amino acid sequences of all of SEQ ID NOs: 167-169 and a second polypeptide chain comprising the amino acid sequences of all of SEQ ID NOs: 170-172;

(16) a first polypeptide chain comprising the amino acid sequences of all of SEQ ID NOs: 177-179 and a second polypeptide chain comprising the amino acid sequences of all of SEQ ID NOs: 180-182;

(17) a first polypeptide chain comprising the amino acid sequences of all of SEQ ID NOs: 187-189 and a second polypeptide chain comprising the amino acid sequences of all of SEQ ID NOs: 190-192;

(18) a first polypeptide chain comprising the amino acid sequences of all of SEQ ID NOs: 197-199 and a second polypeptide chain comprising the amino acid sequences of all of SEQ ID NOs: 200-202;

(19) a first polypeptide chain comprising the amino acid sequences of all of SEQ ID NOs: 207-209 and a second polypeptide chain comprising the amino acid sequences of all of SEQ ID NOs: 210-212;

(20) a first polypeptide chain comprising the amino acid sequences of all of SEQ ID NOs: 217-219 and a second polypeptide chain comprising the amino acid sequences of all of SEQ ID NOs: 220-222;

(21) a first polypeptide chain comprising the amino acid sequences of all of SEQ ID NOs: 227-229 and a second polypeptide chain comprising the amino acid sequences of all of SEQ ID NOs: 230-232;

(22) a first polypeptide chain comprising the amino acid sequences of all of SEQ ID NOs: 237-239 and a second polypeptide chain comprising the amino acid sequences of all of SEQ ID NOs: 240-242;

(23) a first polypeptide chain comprising the amino acid sequences of all of SEQ ID NOs: 247-249 and a second polypeptide chain comprising the amino acid sequences of all of SEQ ID NOs: 250-252;

(24) a first polypeptide chain comprising the amino acid sequences of all of SEQ ID NOs: 257-259 and a second polypeptide chain comprising the amino acid sequences of all of SEQ ID NOs: 260-262;

(25) a first polypeptide chain comprising the amino acid sequences of all of SEQ ID NOs: 267-269 and a second polypeptide chain comprising the amino acid sequences of all of SEQ ID NOs: 270-272;

(26) a first polypeptide chain comprising the amino acid sequences of all of SEQ ID NOs: 277-279 and a second polypeptide chain comprising the amino acid sequences of all of SEQ ID NOs: 280-282;

(27) a first polypeptide chain comprising the amino acid sequences of all of SEQ ID NOs: 287-289 and a second polypeptide chain comprising the amino acid sequences of all of SEQ ID NOs: 290-292;

(28) a first polypeptide chain comprising the amino acid sequences of all of SEQ ID NOs: 297-299 and a second polypeptide chain comprising the amino acid sequences of all of SEQ ID NOs: 300-302;

(29) a first polypeptide chain comprising the amino acid sequences of all of SEQ ID NOs: 307-309 and a second polypeptide chain comprising the amino acid sequences of all of SEQ ID NOs: 310-312;

(30) a first polypeptide chain comprising the amino acid sequences of all of SEQ ID NOs: 317-319 and a second polypeptide chain comprising the amino acid sequences of all of SEQ ID NOs: 320-322;

(31) a first polypeptide chain comprising the amino acid sequences of all of SEQ ID NOs: 327-329 and a second polypeptide chain comprising the amino acid sequences of all of SEQ ID NOs: 330-332;

(32) a first polypeptide chain comprising the amino acid sequences of all of SEQ ID NOs: 337-339 and a second polypeptide chain comprising the amino acid sequences of all of SEQ ID NOs: 340-342;

(33) a first polypeptide chain comprising the amino acid sequences of all of SEQ ID NOs: 347-349 and a second polypeptide chain comprising the amino acid sequences of all of SEQ ID NOs: 350-352;

(34) a first polypeptide chain comprising the amino acid sequences of all of SEQ ID NOs: 357-359 and a second polypeptide chain comprising the amino acid sequences of all of SEQ ID NOs: 360-362;

(35) a first polypeptide chain comprising the amino acid sequences of all of SEQ ID NOs: 367-369 and a second polypeptide chain comprising the amino acid sequences of all of SEQ ID NOs: 370-372;

(36) a first polypeptide chain comprising the amino acid sequences of all of SEQ ID NOs: 377-379 and a second polypeptide chain comprising the amino acid sequences of all of SEQ ID NOs: 380-382;

(37) a first polypeptide chain comprising the amino acid sequences of all of SEQ ID NOs: 387-389 and a second polypeptide chain comprising the amino acid sequences of all of SEQ ID NOs: 390-392;

(38) a first polypeptide chain comprising the amino acid sequences of all of SEQ ID NOs: 397-399 and a second polypeptide chain comprising the amino acid sequences of all of SEQ ID NOs: 400-402;

(39) a first polypeptide chain comprising the amino acid sequences of all of SEQ ID NOs: 407-409 and a second polypeptide chain comprising the amino acid sequences of all of SEQ ID NOs: 410-412;

(40) a first polypeptide chain comprising the amino acid sequences of all of SEQ ID NOs: 417-419 and a second polypeptide chain comprising the amino acid sequences of all of SEQ ID NOs: 420-422;

(41) a first polypeptide chain comprising the amino acid sequences of all of SEQ ID NOs: 427-429 and a second polypeptide chain comprising the amino acid sequences of all of SEQ ID NOs: 430-432;

(42) a first polypeptide chain comprising the amino acid sequences of all of SEQ ID NOs: 437-439 and a second polypeptide chain comprising the amino acid sequences of all of SEQ ID NOs: 440-442;

(43) a first polypeptide chain comprising the amino acid sequences of all of SEQ ID NOs: 447-449 and a second polypeptide chain comprising the amino acid sequences of all of SEQ ID NOs: 450-452;

(44) a first polypeptide chain comprising the amino acid sequences of all of SEQ ID NOs: 457-459 and a second polypeptide chain comprising the amino acid sequences of all of SEQ ID NOs: 460-462;

(45) a first polypeptide chain comprising the amino acid sequences of all of SEQ ID NOs: 477-479 and a second polypeptide chain comprising the amino acid sequences of all of SEQ ID NOs: 480-482; or

(46) a first polypeptide chain comprising the amino acid sequences of all of SEQ ID NOs: 487-489 and a second polypeptide chain comprising the amino acid sequences of all of SEQ ID NOs: 490-492.

16. The protein of claim 15, wherein the protein comprises:

(1) a first polypeptide chain comprising an amino acid sequence at least 99% identical to SEQ ID NO: 33 and a second polypeptide chain comprising an amino acid sequence at least 99% identical to SEQ ID NO: 34;
(2) a first polypeptide chain comprising an amino acid sequence at least 99% identical to SEQ ID NO: 43 and a second polypeptide chain comprising an amino acid sequence at least 99% identical to SEQ ID NO: 44;
(3) a first polypeptide chain comprising an amino acid sequence at least 99% identical to SEQ ID NO: 53 and a second polypeptide chain comprising an amino acid sequence at least 99% identical to SEQ ID NO: 54;
(4) a first polypeptide chain comprising an amino acid sequence at least 99% identical to SEQ ID NO: 63 and a second polypeptide chain comprising an amino acid sequence at least 99% identical to SEQ ID NO: 64;
(5) a first polypeptide chain comprising an amino acid sequence at least 99% identical to SEQ ID NO: 73 and a second polypeptide chain comprising an amino acid sequence at least 99% identical to SEQ ID NO: 74;
(6) a first polypeptide chain comprising an amino acid sequence at least 99% identical to SEQ ID NO: 83 and a second polypeptide chain comprising an amino acid sequence at least 99% identical to SEQ ID NO: 84;
(7) a first polypeptide chain comprising an amino acid sequence at least 99% identical to SEQ ID NO: 93 and a second polypeptide chain comprising an amino acid sequence at least 99% identical to SEQ ID NO: 94;
(8) a first polypeptide chain comprising an amino acid sequence at least 99% identical to SEQ ID NO: 103 and a second polypeptide chain comprising an amino acid sequence at least 99% identical to SEQ ID NO: 104;
(9) a first polypeptide chain comprising an amino acid sequence at least 99% identical to SEQ ID NO: 113 and a second polypeptide chain comprising an amino acid sequence at least 99% identical to SEQ ID NO: 114;
(10) a first polypeptide chain comprising an amino acid sequence at least 99% identical to SEQ ID NO: 123 and a second polypeptide chain comprising an amino acid sequence at least 99% identical to SEQ ID NO: 124;
(11) a first polypeptide chain comprising an amino acid sequence at least 99% identical to SEQ ID NO: 133 and a second polypeptide chain comprising an amino acid sequence at least 99% identical to SEQ ID NO: 134;
(12) a first polypeptide chain comprising an amino acid sequence at least 99% identical to SEQ ID NO: 143 and a second polypeptide chain comprising an amino acid sequence at least 99% identical to SEQ ID NO: 144;
(13) a first polypeptide chain comprising an amino acid sequence at least 99% identical to SEQ ID NO: 153 and a second polypeptide chain comprising an amino acid sequence at least 99% identical to SEQ ID NO: 154;
(14) a first polypeptide chain comprising an amino acid sequence at least 99% identical to SEQ ID NO: 163 and a second polypeptide chain comprising an amino acid sequence at least 99% identical to SEQ ID NO: 164;
(15) a first polypeptide chain comprising an amino acid sequence at least 99% identical to SEQ ID NO: 173 and a second polypeptide chain comprising an amino acid sequence at least 99% identical to SEQ ID NO: 174;
(16) a first polypeptide chain comprising an amino acid sequence at least 99% identical to SEQ ID NO: 183 and a second polypeptide chain comprising an amino acid sequence at least 99% identical to SEQ ID NO: 184;
(17) a first polypeptide chain comprising an amino acid sequence at least 99% identical to SEQ ID NO: 193 and a second polypeptide chain comprising an amino acid sequence at least 99% identical to SEQ ID NO: 194;
(18) a first polypeptide chain comprising an amino acid sequence at least 99% identical to SEQ ID NO: 203 and a second polypeptide chain comprising an amino acid sequence at least 99% identical to SEQ ID NO: 204;
(19) a first polypeptide chain comprising an amino acid sequence at least 99% identical to SEQ ID NO: 213 and a second polypeptide chain comprising an amino acid sequence at least 99% identical to SEQ ID NO: 214;
(20) a first polypeptide chain comprising an amino acid sequence at least 99% identical to SEQ ID NO: 223 and a second polypeptide chain comprising an amino acid sequence at least 99% identical to SEQ ID NO: 224;
(21) a first polypeptide chain comprising an amino acid sequence at least 99% identical to SEQ ID NO: 233 and a second polypeptide chain comprising an amino acid sequence at least 99% identical to SEQ ID NO: 234;
(22) a first polypeptide chain comprising an amino acid sequence at least 99% identical to SEQ ID NO: 243 and a second polypeptide chain comprising an amino acid sequence at least 99% identical to SEQ ID NO: 244;
(23) a first polypeptide chain comprising an amino acid sequence at least 99% identical to SEQ ID NO: 253 and a second polypeptide chain comprising an amino acid sequence at least 99% identical to SEQ ID NO: 254;
(24) a first polypeptide chain comprising an amino acid sequence at least 99% identical to SEQ ID NO: 263 and a second polypeptide chain comprising an amino acid sequence at least 99% identical to SEQ ID NO: 264;
(25) a first polypeptide chain comprising an amino acid sequence at least 99% identical to SEQ ID NO: 273 and a second polypeptide chain comprising an amino acid sequence at least 99% identical to SEQ ID NO: 274;
(26) a first polypeptide chain comprising an amino acid sequence at least 99% identical to SEQ ID NO: 283 and a second polypeptide chain comprising an amino acid sequence at least 99% identical to SEQ ID NO: 284;
(27) a first polypeptide chain comprising an amino acid sequence at least 99% identical to SEQ ID NO: 293 and a second polypeptide chain comprising an amino acid sequence at least 99% identical to SEQ ID NO: 294;
(28) a first polypeptide chain comprising an amino acid sequence at least 99% identical to SEQ ID NO: 303 and a second polypeptide chain comprising an amino acid sequence at least 99% identical to SEQ ID NO: 304;
(29) a first polypeptide chain comprising an amino acid sequence at least 99% identical to SEQ ID NO: 313 and a second polypeptide chain comprising an amino acid sequence at least 99% identical to SEQ ID NO: 314;
(30) a first polypeptide chain comprising an amino acid sequence at least 99% identical to SEQ ID NO: 323 and a second polypeptide chain comprising an amino acid sequence at least 99% identical to SEQ ID NO: 324;
(31) a first polypeptide chain comprising an amino acid sequence at least 99% identical to SEQ ID NO: 333 and a second polypeptide chain comprising an amino acid sequence at least 99% identical to SEQ ID NO: 334;
(32) a first polypeptide chain comprising an amino acid sequence at least 99% identical to SEQ ID NO: 343 and a second polypeptide chain comprising an amino acid sequence at least 99% identical to SEQ ID NO: 344;

(33) a first polypeptide chain comprising an amino acid sequence at least 99% identical to SEQ ID NO: 353 and a second polypeptide chain comprising an amino acid sequence at least 99% identical to SEQ ID NO: 354;
(34) a first polypeptide chain comprising an amino acid sequence at least 99% identical to SEQ ID NO: 363 and a second polypeptide chain comprising an amino acid sequence at least 99% identical to SEQ ID NO: 364;
(35) a first polypeptide chain comprising an amino acid sequence at least 99% identical to SEQ ID NO: 373 and a second polypeptide chain comprising an amino acid sequence at least 99% identical to SEQ ID NO: 374;
(36) a first polypeptide chain comprising an amino acid sequence at least 99% identical to SEQ ID NO: 383 and a second polypeptide chain comprising an amino acid sequence at least 99% identical to SEQ ID NO: 384;
(37) a first polypeptide chain comprising an amino acid sequence at least 99% identical to SEQ ID NO: 393 and a second polypeptide chain comprising an amino acid sequence at least 99% identical to SEQ ID NO: 394;
(38) a first polypeptide chain comprising an amino acid sequence at least 99% identical to SEQ ID NO: 403 and a second polypeptide chain comprising an amino acid sequence at least 99% identical to SEQ ID NO: 404;
(39) a first polypeptide chain comprising an amino acid sequence at least 99% identical to SEQ ID NO: 413 and a second polypeptide chain comprising an amino acid sequence at least 99% identical to SEQ ID NO: 414;
(40) a first polypeptide chain comprising an amino acid sequence at least 99% identical to SEQ ID NO: 423 and a second polypeptide chain comprising an amino acid sequence at least 99% identical to SEQ ID NO: 424;
(41) a first polypeptide chain comprising an amino acid sequence at least 99% identical to SEQ ID NO: 433 and a second polypeptide chain comprising an amino acid sequence at least 99% identical to SEQ ID NO: 434;
(42) a first polypeptide chain comprising an amino acid sequence at least 99% identical to SEQ ID NO: 443 and a second polypeptide chain comprising an amino acid sequence at least 99% identical to SEQ ID NO: 444;
(43) a first polypeptide chain comprising an amino acid sequence at least 99% identical to SEQ ID NO: 453 and a second polypeptide chain comprising an amino acid sequence at least 99% identical to SEQ ID NO: 454;
(44) a first polypeptide chain comprising an amino acid sequence at least 99% identical to SEQ ID NO: 463 and a second polypeptide chain comprising an amino acid sequence at least 99% identical to SEQ ID NO: 464;
(45) a first polypeptide chain comprising an amino acid sequence at least 99% identical to SEQ ID NO: 483 and a second polypeptide chain comprising an amino acid sequence at least 99% identical to SEQ ID NO: 484;
(46) a first polypeptide chain comprising an amino acid sequence at least 99% identical to SEQ ID NO: 493 and a second polypeptide chain comprising an amino acid sequence at least 99% identical to SEQ ID NO: 494
(47) a first polypeptide chain comprising an amino acid sequence at least 99% identical to amino acids 21-130 of SEQ ID NO: 33 and a second polypeptide chain comprising an amino acid sequence at least 99% identical to amino acids 22-131 of SEQ ID NO: 34;
(48) a first polypeptide chain comprising an amino acid sequence at least 99% identical to amino acids 22-135 of SEQ ID NO: 43 and a second polypeptide chain comprising an amino acid sequence at least 99% identical to amino acids 20-132 SEQ ID NO: 44;
(49) a first polypeptide chain comprising an amino acid sequence at least 99% identical to amino acids 19-127 SEQ ID NO: 53 and a second polypeptide chain comprising an amino acid sequence at least 99% identical to amino acids 24-134 of SEQ ID NO: 54;
(50) a first polypeptide chain comprising an amino acid sequence at least 99% identical to amino acids 21-131 of SEQ ID NO: 63 and a second polypeptide chain comprising an amino acid sequence at least 99% identical to amino acids 22-132 of SEQ ID NO: 64;
(51) a first polypeptide chain comprising an amino acid sequence at least 99% identical to amino acids 21-131 of SEQ ID NO: 73 and a second polypeptide chain comprising an amino acid sequence at least 99% identical to amino acids 22-134 of SEQ ID NO: 74;
(52) a first polypeptide chain comprising an amino acid sequence at least 99% identical to amino acids 22-137 of SEQ ID NO: 83 and a second polypeptide chain comprising an amino acid sequence at least 99% identical to amino acids 22-133 of SEQ ID NO: 84;
(53) a first polypeptide chain comprising an amino acid sequence at least 99% identical to amino acids 22-131 of SEQ ID NO: 93 and a second polypeptide chain comprising an amino acid sequence at least 99% identical to amino acids 22-134 of SEQ ID NO: 94;
(54) a first polypeptide chain comprising an amino acid sequence at least 99% identical to amino acids 21-133 of SEQ ID NO: 103 and a second polypeptide chain comprising an amino acid sequence at least 99% identical to amino acids 22-129 of SEQ ID NO: 104;
(55) a first polypeptide chain comprising an amino acid sequence at least 99% identical to amino acids 19-126 of SEQ ID NO: 113 and a second polypeptide chain comprising an amino acid sequence at least 99% identical to amino acids 22-134 of SEQ ID NO: 114;
(56) a first polypeptide chain comprising an amino acid sequence at least 99% identical to amino acids 19-128 of SEQ ID NO: 123 and a second polypeptide chain comprising an amino acid sequence at least 99% identical to amino acids 22-134 of SEQ ID NO: 124;
(57) a first polypeptide chain comprising an amino acid sequence at least 99% identical to amino acids 19-128 of SEQ ID NO: 133 and a second polypeptide chain comprising an amino acid sequence at least 99% identical to amino acids 22-134 of SEQ ID NO: 134;
(58) a first polypeptide chain comprising an amino acid sequence at least 99% identical to amino acids 21-130 of SEQ ID NO: 143 and a second polypeptide chain comprising an amino acid sequence at least 99% identical to amino acids 22-131 of SEQ ID NO: 144;
(59) a first polypeptide chain comprising an amino acid sequence at least 99% identical to amino acids 20-128 of SEQ ID NO: 153 and a second polypeptide chain comprising an amino acid sequence at least 99% identical to amino acids 22-132 of SEQ ID NO: 154;
(60) a first polypeptide chain comprising an amino acid sequence at least 99% identical to amino acids 21-135 of SEQ ID NO: 163 and a second polypeptide chain comprising an amino acid sequence at least 99% identical to amino acids 22-132 of SEQ ID NO: 164;
(61) a first polypeptide chain comprising an amino acid sequence at least 99% identical to amino acids 21-133 of SEQ ID NO: 173 and a second polypeptide chain comprising an amino acid sequence at least 99% identical to amino acids 27-132 of SEQ ID NO: 174;
(62) a first polypeptide chain comprising an amino acid sequence at least 99% identical to amino acids 19-129 of SEQ ID NO: 183 and a second polypeptide chain comprising an amino acid sequence at least 99% identical to amino acids 27-132 of SEQ ID NO: 184;

(63) a first polypeptide chain comprising an amino acid sequence at least 99% identical to amino acids 22-134 of SEQ ID NO: 193 and a second polypeptide chain comprising an amino acid sequence at least 99% identical to amino acids 20-131 of SEQ ID NO: 194;

(64) a first polypeptide chain comprising an amino acid sequence at least 99% identical to amino acids 21-135 of SEQ ID NO: 203 and a second polypeptide chain comprising an amino acid sequence at least 99% identical to amino acids 22-134 of SEQ ID NO: 204;

(65) a first polypeptide chain comprising an amino acid sequence at least 99% identical to amino acids 22-136 of SEQ ID NO: 213 and a second polypeptide chain comprising an amino acid sequence at least 99% identical to amino acids 22-134 of SEQ ID NO: 214;

(66) a first polypeptide chain comprising an amino acid sequence at least 99% identical to amino acids 22-136 of SEQ ID NO: 223 and a second polypeptide chain comprising an amino acid sequence at least 99% identical to amino acids 22-134 of SEQ ID NO: 224;

(67) a first polypeptide chain comprising an amino acid sequence at least 99% identical to amino acids 22-134 of SEQ ID NO: 233 and a second polypeptide chain comprising an amino acid sequence at least 99% identical to amino acids 22-140 of SEQ ID NO: 234;

(68) a first polypeptide chain comprising an amino acid sequence at least 99% identical to amino acids 22-134 of SEQ ID NO: 243 and a second polypeptide chain comprising an amino acid sequence at least 99% identical to amino acids 17-130 of SEQ ID NO: 244;

(69) a first polypeptide chain comprising an amino acid sequence at least 99% identical to amino acids 20-125 of SEQ ID NO: 253 and a second polypeptide chain comprising an amino acid sequence at least 99% identical to amino acids 27-134 of SEQ ID NO: 254;

(70) a first polypeptide chain comprising an amino acid sequence at least 99% identical to amino acids 21-135 of SEQ ID NO: 263 and a second polypeptide chain comprising an amino acid sequence at least 99% identical to amino acids 22-138 of SEQ ID NO: 264;

(71) a first polypeptide chain comprising an amino acid sequence at least 99% identical to amino acids 23-136 of SEQ ID NO: 273 and a second polypeptide chain comprising an amino acid sequence at least 99% identical to amino acids 22-141 of SEQ ID NO: 274;

(72) a first polypeptide chain comprising an amino acid sequence at least 99% identical to amino acids 23-136 of SEQ ID NO: 283 and a second polypeptide chain comprising an amino acid sequence at least 99% identical to amino acids 17-131 of SEQ ID NO: 284;

(73) a first polypeptide chain comprising an amino acid sequence at least 99% identical to amino acids 22-135 of SEQ ID NO: 293 and a second polypeptide chain comprising an amino acid sequence at least 99% identical to amino acids 22-134 of SEQ ID NO: 294;

(74) a first polypeptide chain comprising an amino acid sequence at least 99% identical to amino acids 22-134 of SEQ ID NO: 303 and a second polypeptide chain comprising an amino acid sequence at least 99% identical to amino acids 22-133 of SEQ ID NO: 304;

(75) a first polypeptide chain comprising an amino acid sequence at least 99% identical to amino acids 23-134 of SEQ ID NO: 313 and a second polypeptide chain comprising an amino acid sequence at least 99% identical to amino acids 22-134 of SEQ ID NO: 314;

(76) a first polypeptide chain comprising an amino acid sequence at least 99% identical to amino acids 22-136 of SEQ ID NO: 323 and a second polypeptide chain comprising an amino acid sequence at least 99% identical to amino acids 22-135 of SEQ ID NO: 324;

(77) a first polypeptide chain comprising an amino acid sequence at least 99% identical to amino acids 19-125 of SEQ ID NO: 333 and a second polypeptide chain comprising an amino acid sequence at least 99% identical to amino acids 22-133 of SEQ ID NO: 334;

(78) a first polypeptide chain comprising an amino acid sequence at least 99% identical to amino acids 22-130 of SEQ ID NO: 343 and a second polypeptide chain comprising an amino acid sequence at least 99% identical to amino acids 22-132 of SEQ ID NO: 344;

(79) a first polypeptide chain comprising an amino acid sequence at least 99% identical to amino acids 22-130 of SEQ ID NO: 353 and a second polypeptide chain comprising an amino acid sequence at least 99% identical to amino acids 22-134 of SEQ ID NO: 354;

(80) a first polypeptide chain comprising an amino acid sequence at least 99% identical to amino acids 22-130 of SEQ ID NO: 363 and a second polypeptide chain comprising an amino acid sequence at least 99% identical to amino acids 22-134 of SEQ ID NO: 364;

(81) a first polypeptide chain comprising an amino acid sequence at least 99% identical to amino acids 21-133 of SEQ ID NO: 373 and a second polypeptide chain comprising an amino acid sequence at least 99% identical to amino acids 22-125 of SEQ ID NO: 374;

(82) a first polypeptide chain comprising an amino acid sequence at least 99% identical to amino acids 20-128 of SEQ ID NO: 383 and a second polypeptide chain comprising an amino acid sequence at least 99% identical to amino acids 25-132 of SEQ ID NO: 384;

(83) a first polypeptide chain comprising an amino acid sequence at least 99% identical to amino acids 22-131 of SEQ ID NO: 393 and a second polypeptide chain comprising an amino acid sequence at least 99% identical to amino acids 22-134 of SEQ ID NO: 394;

(84) a first polypeptide chain comprising an amino acid sequence at least 99% identical to amino acids 21-134 of SEQ ID NO: 403 and a second polypeptide chain comprising an amino acid sequence at least 99% identical to amino acids 22-134 of SEQ ID NO: 404;

(85) a first polypeptide chain comprising an amino acid sequence at least 99% identical to amino acids 21-134 of SEQ ID NO: 413 and a second polypeptide chain comprising an amino acid sequence at least 99% identical to amino acids 22-134 of SEQ ID NO: 414;

(86) a first polypeptide chain comprising an amino acid sequence at least 99% identical to amino acids 21-134 of SEQ ID NO: 423 and a second polypeptide chain comprising an amino acid sequence at least 99% identical to amino acids 22-134 of SEQ ID NO: 424;

(87) a first polypeptide chain comprising an amino acid sequence at least 99% identical to amino acids 21-134 of SEQ ID NO: 433 and a second polypeptide chain comprising an amino acid sequence at least 99% identical to amino acids 22-134 of SEQ ID NO: 434;

(88) a first polypeptide chain comprising an amino acid sequence at least 99% identical to amino acids 21-133 of SEQ ID NO: 443 and a second polypeptide chain comprising an amino acid sequence at least 99% identical to amino acids 22-130 of SEQ ID NO: 444;

(89) a first polypeptide chain comprising an amino acid sequence at least 99% identical to amino acids 21-133 of SEQ ID NO: 453 and a second polypeptide chain comprising an amino acid sequence at least 99% identical to amino acids 22-130 of SEQ ID NO: 454;

(90) a first polypeptide chain comprising an amino acid sequence at least 99% identical to amino acids 21-131 of SEQ ID NO: 463 and a second polypeptide chain comprising an amino acid sequence at least 99% identical to amino acids 22-140 of SEQ ID NO: 464;

(91) a first polypeptide chain comprising an amino acid sequence at least 99% identical to amino acids 21-133 of SEQ ID NO: 483 and a second polypeptide chain comprising an amino acid sequence at least 99% identical to amino acids 22-133 of SEQ ID NO: 484; or

(92) a first polypeptide chain comprising an amino acid sequence at least 99% identical to amino acids 23-134 of SEQ ID NO: 493 and a second polypeptide chain comprising an amino acid sequence at least 99% identical to amino acids 22-132 of SEQ ID NO: 494.

17. The protein of claim 15, wherein the protein comprises:

(1) a first polypeptide chain comprising the amino acid sequence of SEQ ID NO: 33 and a second polypeptide chain comprising the amino acid sequence of SEQ ID NO: 34;

(2) a first polypeptide chain comprising the amino acid sequence of SEQ ID NO: 43 and a second polypeptide chain comprising the amino acid sequence of SEQ ID NO: 44;

(3) a first polypeptide chain comprising the amino acid sequence of SEQ ID NO: 53 and a second polypeptide chain comprising the amino acid sequence of SEQ ID NO: 54;

(4) a first polypeptide chain comprising the amino acid sequence of SEQ ID NO: 63 and a second polypeptide chain comprising the amino acid sequence of SEQ ID NO: 64;

(5) a first polypeptide chain comprising the amino acid sequence of SEQ ID NO: 73 and a second polypeptide chain comprising the amino acid sequence of SEQ ID NO: 74;

(6) a first polypeptide chain comprising the amino acid sequence of SEQ ID NO: 83 and a second polypeptide chain comprising the amino acid sequence of SEQ ID NO: 84;

(7) a first polypeptide chain comprising the amino acid sequence of SEQ ID NO: 93 and a second polypeptide chain comprising the amino acid sequence of SEQ ID NO: 94;

(8) a first polypeptide chain comprising the amino acid sequence of SEQ ID NO: 103 and a second polypeptide chain comprising the amino acid sequence of SEQ ID NO: 104;

(9) a first polypeptide chain comprising the amino acid sequence of SEQ ID NO: 113 and a second polypeptide chain comprising the amino acid sequence of SEQ ID NO: 114;

(10) a first polypeptide chain comprising the amino acid sequence of SEQ ID NO: 123 and a second polypeptide chain comprising the amino acid sequence of SEQ ID NO: 124;

(11) a first polypeptide chain comprising the amino acid sequence of SEQ ID NO: 133 and a second polypeptide chain comprising the amino acid sequence of SEQ ID NO: 134;

(12) a first polypeptide chain comprising the amino acid sequence of SEQ ID NO: 143 and a second polypeptide chain comprising the amino acid sequence of SEQ ID NO: 144;

(13) a first polypeptide chain comprising the amino acid sequence of SEQ ID NO: 153 and a second polypeptide chain comprising the amino acid sequence of SEQ ID NO: 154;

(14) a first polypeptide chain comprising the amino acid sequence of SEQ ID NO: 163 and a second polypeptide chain comprising the amino acid sequence of SEQ ID NO: 164;

(15) a first polypeptide chain comprising the amino acid sequence of SEQ ID NO: 173 and a second polypeptide chain comprising the amino acid sequence of SEQ ID NO: 174;

(16) a first polypeptide chain comprising the amino acid sequence of SEQ ID NO: 183 and a second polypeptide chain comprising the amino acid sequence of SEQ ID NO: 184;

(17) a first polypeptide chain comprising the amino acid sequence of SEQ ID NO: 193 and a second polypeptide chain comprising the amino acid sequence of SEQ ID NO: 194;

(18) a first polypeptide chain comprising the amino acid sequence of SEQ ID NO: 203 and a second polypeptide chain comprising the amino acid sequence of SEQ ID NO: 204;

(19) a first polypeptide chain comprising the amino acid sequence of SEQ ID NO: 213 and a second polypeptide chain comprising the amino acid sequence of SEQ ID NO: 214;

(20) a first polypeptide chain comprising the amino acid sequence of SEQ ID NO: 223 and a second polypeptide chain comprising the amino acid sequence of SEQ ID NO: 224;

(21) a first polypeptide chain comprising the amino acid sequence of SEQ ID NO: 233 and a second polypeptide chain comprising the amino acid sequence of SEQ ID NO: 234;

(22) a first polypeptide chain comprising the amino acid sequence of SEQ ID NO: 243 and a second polypeptide chain comprising the amino acid sequence of SEQ ID NO: 244;

(23) a first polypeptide chain comprising the amino acid sequence of SEQ ID NO: 253 and a second polypeptide chain comprising the amino acid sequence of SEQ ID NO: 254;

(24) a first polypeptide chain comprising the amino acid sequence of SEQ ID NO: 263 and a second polypeptide chain comprising the amino acid sequence of SEQ ID NO: 264;

(25) a first polypeptide chain comprising the amino acid sequence of SEQ ID NO: 273 and a second polypeptide chain comprising the amino acid sequence of SEQ ID NO: 274;

(26) a first polypeptide chain comprising the amino acid sequence of SEQ ID NO: 283 and a second polypeptide chain comprising the amino acid sequence of SEQ ID NO: 284;

(27) a first polypeptide chain comprising the amino acid sequence of SEQ ID NO: 293 and a second polypeptide chain comprising the amino acid sequence of SEQ ID NO: 294;

(28) a first polypeptide chain comprising the amino acid sequence of SEQ ID NO: 303 and a second polypeptide chain comprising the amino acid sequence of SEQ ID NO: 304;
(29) a first polypeptide chain comprising the amino acid sequence of SEQ ID NO: 313 and a second polypeptide chain comprising the amino acid sequence of SEQ ID NO: 314;
(30) a first polypeptide chain comprising the amino acid sequence of SEQ ID NO: 323 and a second polypeptide chain comprising the amino acid sequence of SEQ ID NO: 324;
(31) a first polypeptide chain comprising the amino acid sequence of SEQ ID NO: 333 and a second polypeptide chain comprising the amino acid sequence of SEQ ID NO: 334;
(32) a first polypeptide chain comprising the amino acid sequence of SEQ ID NO: 343 and a second polypeptide chain comprising the amino acid sequence of SEQ ID NO: 344;
(33) a first polypeptide chain comprising the amino acid sequence of SEQ ID NO: 353 and a second polypeptide chain comprising the amino acid sequence of SEQ ID NO: 354;
(34) a first polypeptide chain comprising the amino acid sequence of SEQ ID NO: 363 and a second polypeptide chain comprising the amino acid sequence of SEQ ID NO: 364;
(35) a first polypeptide chain comprising the amino acid sequence of SEQ ID NO: 373 and a second polypeptide chain comprising the amino acid sequence of SEQ ID NO: 374;
(36) a first polypeptide chain comprising the amino acid sequence of SEQ ID NO: 383 and a second polypeptide chain comprising the amino acid sequence of SEQ ID NO: 384;
(37) a first polypeptide chain comprising the amino acid sequence of SEQ ID NO: 393 and a second polypeptide chain comprising the amino acid sequence of SEQ ID NO: 394;
(38) a first polypeptide chain comprising the amino acid sequence of SEQ ID NO: 403 and a second polypeptide chain comprising the amino acid sequence of SEQ ID NO: 404;
(39) a first polypeptide chain comprising the amino acid sequence of SEQ ID NO: 413 and a second polypeptide chain comprising the amino acid sequence of SEQ ID NO: 414;
(40) a first polypeptide chain comprising the amino acid sequence of SEQ ID NO: 423 and a second polypeptide chain comprising the amino acid sequence of SEQ ID NO: 424;
(41) a first polypeptide chain comprising the amino acid sequence of SEQ ID NO: 433 and a second polypeptide chain comprising the amino acid sequence of SEQ ID NO: 434;
(42) a first polypeptide chain comprising the amino acid sequence of SEQ ID NO: 443 and a second polypeptide chain comprising the amino acid sequence of SEQ ID NO: 444;
(43) a first polypeptide chain comprising the amino acid sequence of SEQ ID NO: 453 and a second polypeptide chain comprising the amino acid sequence of SEQ ID NO: 454;
(44) a first polypeptide chain comprising the amino acid sequence of SEQ ID NO: 463 and a second polypeptide chain comprising the amino acid sequence of SEQ ID NO: 464;
(45) a first polypeptide chain comprising the amino acid sequence of SEQ ID NO: 483 and a second polypeptide chain comprising the amino acid sequence of SEQ ID NO: 484;
(46) a first polypeptide chain comprising the amino acid sequence of SEQ ID NO: 493 and a second polypeptide chain comprising the amino acid sequence of SEQ ID NO: 494;
(47) a first polypeptide chain comprising amino acids 21-130 of SEQ ID NO: 33 and a second polypeptide chain comprising amino acids 22-131 of SEQ ID NO: 34;
(48) a first polypeptide chain comprising amino acids 22-135 of SEQ ID NO: 43 and a second polypeptide chain comprising amino acids 20-132 SEQ ID NO: 44;
(49) a first polypeptide chain comprising amino acids 19-127 SEQ ID NO: 53 and a second polypeptide chain comprising amino acids 24-134 of SEQ ID NO: 54;
(50) a first polypeptide chain comprising amino acids 21-131 of SEQ ID NO: 63 and a second polypeptide chain comprising amino acids 22-132 of SEQ ID NO: 64;
(51) a first polypeptide chain comprising amino acids 21-131 of SEQ ID NO: 73 and a second polypeptide chain comprising amino acids 22-134 of SEQ ID NO: 74;
(52) a first polypeptide chain comprising amino acids 22-137 of SEQ ID NO: 83 and a second polypeptide chain comprising amino acids 22-133 of SEQ ID NO: 84;
(53) a first polypeptide chain comprising amino acids 22-131 of SEQ ID NO: 93 and a second polypeptide chain comprising amino acids 22-134 of SEQ ID NO: 94;
(54) a first polypeptide chain comprising amino acids 21-133 of SEQ ID NO: 103 and a second polypeptide chain comprising amino acids 22-129 of SEQ ID NO: 104;
(55) a first polypeptide chain comprising amino acids 19-126 of SEQ ID NO: 113 and a second polypeptide chain comprising amino acids 22-134 of SEQ ID NO: 114;
(56) a first polypeptide chain comprising amino acids 19-128 of SEQ ID NO: 123 and a second polypeptide chain comprising amino acids 22-134 of SEQ ID NO: 124;
(57) a first polypeptide chain comprising amino acids 19-128 of SEQ ID NO: 133 and a second polypeptide chain comprising amino acids 22-134 of SEQ ID NO: 134;
(58) a first polypeptide chain comprising amino acids 21-130 of SEQ ID NO: 143 and a second polypeptide chain comprising amino acids 22-131 of SEQ ID NO: 144;
(59) a first polypeptide chain comprising amino acids 20-128 of SEQ ID NO: 153 and a second polypeptide chain comprising amino acids 22-132 of SEQ ID NO: 154;
(60) a first polypeptide chain comprising amino acids 21-135 of SEQ ID NO: 163 and a second polypeptide chain comprising amino acids 22-132 of SEQ ID NO: 164;

(61) a first polypeptide chain comprising amino acids 21-133 of SEQ ID NO: 173 and a second polypeptide chain comprising amino acids 27-131 of SEQ ID NO: 174;

(62) a first polypeptide chain comprising amino acids 19-129 of SEQ ID NO: 183 and a second polypeptide chain comprising amino acids 27-132 of SEQ ID NO: 184;

(63) a first polypeptide chain comprising amino acids 22-134 of SEQ ID NO: 193 and a second polypeptide chain comprising amino acids 20-131 of SEQ ID NO: 194;

(64) a first polypeptide chain comprising amino acids 21-135 of SEQ ID NO: 203 and a second polypeptide chain comprising amino acids 22-134 of SEQ ID NO: 204;

(65) a first polypeptide chain comprising amino acids 22-136 of SEQ ID NO: 213 and a second polypeptide chain comprising amino acids 22-134 of SEQ ID NO: 214;

(66) a first polypeptide chain comprising amino acids 22-136 of SEQ ID NO: 223 and a second polypeptide chain comprising amino acids 22-134 of SEQ ID NO: 224;

(67) a first polypeptide chain comprising amino acids 22-134 of SEQ ID NO: 233 and a second polypeptide chain comprising amino acids 22-140 of SEQ ID NO: 234;

(68) a first polypeptide chain comprising amino acids 22-134 of SEQ ID NO: 243 and a second polypeptide chain comprising amino acids 17-130 of SEQ ID NO: 244;

(69) a first polypeptide chain comprising amino acids 20-125 of SEQ ID NO: 253 and a second polypeptide chain comprising amino acids 27-134 of SEQ ID NO: 254;

(70) a first polypeptide chain comprising amino acids 21-135 of SEQ ID NO: 263 and a second polypeptide chain comprising amino acids 22-138 of SEQ ID NO: 264;

(71) a first polypeptide chain comprising amino acids 23-136 of SEQ ID NO: 273 and a second polypeptide chain comprising amino acids 22-141 of SEQ ID NO: 274;

(72) a first polypeptide chain comprising amino acids 23-136 of SEQ ID NO: 283 and a second polypeptide chain comprising amino acids 17-131 of SEQ ID NO: 284;

(73) a first polypeptide chain comprising amino acids 22-135 of SEQ ID NO: 293 and a second polypeptide chain comprising amino acids 22-134 of SEQ ID NO: 294;

(74) a first polypeptide chain comprising amino acids 22-134 of SEQ ID NO: 303 and a second polypeptide chain comprising amino acids 22-133 of SEQ ID NO: 304;

(75) a first polypeptide chain comprising amino acids 23-134 of SEQ ID NO: 313 and a second polypeptide chain comprising amino acids 22-134 of SEQ ID NO: 314;

(76) a first polypeptide chain comprising amino acids 22-136 of SEQ ID NO: 323 and a second polypeptide chain comprising amino acids 22-135 of SEQ ID NO: 324;

(77) a first polypeptide chain comprising amino acids 19-125 of SEQ ID NO: 333 and a second polypeptide chain comprising amino acids 22-133 of SEQ ID NO: 334;

(78) a first polypeptide chain comprising amino acids 22-130 of SEQ ID NO: 343 and a second polypeptide chain comprising amino acids 22-132 of SEQ ID NO: 344;

(79) a first polypeptide chain comprising amino acids 22-130 of SEQ ID NO: 353 and a second polypeptide chain comprising amino acids 22-134 of SEQ ID NO: 354;

(80) a first polypeptide chain comprising amino acids 22-130 of SEQ ID NO: 363 and a second polypeptide chain comprising amino acids 22-134 of SEQ ID NO: 364;

(81) a first polypeptide chain comprising amino acids 21-133 of SEQ ID NO: 373 and a second polypeptide chain comprising amino acids 22-125 of SEQ ID NO: 374;

(82) a first polypeptide chain comprising amino acids 20-128 of SEQ ID NO: 383 and a second polypeptide chain comprising amino acids 25-132 of SEQ ID NO: 384;

(83) a first polypeptide chain comprising amino acids 22-131 of SEQ ID NO: 393 and a second polypeptide chain comprising amino acids 22-134 of SEQ ID NO: 394;

(84) a first polypeptide chain comprising amino acids 21-134 of SEQ ID NO: 403 and a second polypeptide chain comprising amino acids 22-134 of SEQ ID NO: 404;

(85) a first polypeptide chain comprising amino acids 21-134 of SEQ ID NO: 413 and a second polypeptide chain comprising amino acids 22-134 of SEQ ID NO: 414;

(86) a first polypeptide chain comprising amino acids 21-134 of SEQ ID NO: 423 and a second polypeptide chain comprising amino acids 22-134 of SEQ ID NO: 424;

(87) a first polypeptide chain comprising amino acids 21-134 of SEQ ID NO: 433 and a second polypeptide chain comprising amino acids 22-134 of SEQ ID NO: 434;

(88) a first polypeptide chain comprising amino acids 21-133 of SEQ ID NO: 443 and a second polypeptide chain comprising amino acids 22-130 of SEQ ID NO: 444;

(89) a first polypeptide chain comprising amino acids 21-133 of SEQ ID NO: 453 and a second polypeptide chain comprising amino acids 22-130 of SEQ ID NO: 454;

(90) a first polypeptide chain comprising amino acids 22-130 of SEQ ID NO: 463 and a second polypeptide chain comprising amino acids 22-140 of SEQ ID NO: 464;

(91) a first polypeptide chain comprising amino acids 21-133 of SEQ ID NO: 483 and a second polypeptide chain comprising to amino acids 22-133 of SEQ ID NO: 484; or

(92) a first polypeptide chain comprising amino acids 23-134 of SEQ ID NO: 493 and a second polypeptide chain comprising amino acids 22-132 of SEQ ID NO: 494.

18. The protein of claim 15, wherein the protein comprises:
- (1) a first polypeptide chain comprising an amino acid sequence at least 99% identical to SEQ ID NO: 35 and a second polypeptide chain comprising an amino acid sequence at least 99% identical to SEQ ID NO: 36;
- (2) a first polypeptide chain comprising an amino acid sequence at least 99% identical to SEQ ID NO: 45 and a second polypeptide chain comprising an amino acid sequence at least 99% identical to SEQ ID NO: 46;
- (3) a first polypeptide chain comprising an amino acid sequence at least 99% identical to SEQ ID NO: 55 and a second polypeptide chain comprising an amino acid sequence at least 99% identical to SEQ ID NO: 56;
- (4) a first polypeptide chain comprising an amino acid sequence at least 99% identical to SEQ ID NO: 65 and a second polypeptide chain comprising an amino acid sequence at least 99% identical to SEQ ID NO: 66;
- (5) a first polypeptide chain comprising an amino acid sequence at least 99% identical to SEQ ID NO: 75 and a second polypeptide chain comprising an amino acid sequence at least 99% identical to SEQ ID NO: 76;
- (6) a first polypeptide chain comprising an amino acid sequence at least 99% identical to SEQ ID NO: 85 and a second polypeptide chain comprising an amino acid sequence at least 99% identical to SEQ ID NO: 86;
- (7) a first polypeptide chain comprising an amino acid sequence at least 99% identical to SEQ ID NO: 95 and a second polypeptide chain comprising an amino acid sequence at least 99% identical to SEQ ID NO: 96;
- (8) a first polypeptide chain comprising an amino acid sequence at least 99% identical to SEQ ID NO: 105 and a second polypeptide chain comprising an amino acid sequence at least 99% identical to SEQ ID NO: 106;
- (9) a first polypeptide chain comprising an amino acid sequence at least 99% identical to SEQ ID NO: 115 and a second polypeptide chain comprising an amino acid sequence at least 99% identical to SEQ ID NO: 116;
- (10) a first polypeptide chain comprising an amino acid sequence at least 99% identical to SEQ ID NO: 125 and a second polypeptide chain comprising an amino acid sequence at least 99% identical to SEQ ID NO: 126;
- (11) a first polypeptide chain comprising an amino acid sequence at least 99% identical to SEQ ID NO: 135 and a second polypeptide chain comprising an amino acid sequence at least 99% identical to SEQ ID NO: 136;
- (12) a first polypeptide chain comprising an amino acid sequence at least 99% identical to SEQ ID NO: 145 and a second polypeptide chain comprising an amino acid sequence at least 99% identical to SEQ ID NO: 146;
- (13) a first polypeptide chain comprising an amino acid sequence at least 99% identical to SEQ ID NO: 155 and a second polypeptide chain comprising an amino acid sequence at least 99% identical to SEQ ID NO: 156;
- (14) a first polypeptide chain comprising an amino acid sequence at least 99% identical to SEQ ID NO: 165 and a second polypeptide chain comprising an amino acid sequence at least 99% identical to SEQ ID NO: 166;
- (15) a first polypeptide chain comprising an amino acid sequence at least 99% identical to SEQ ID NO: 175 and a second polypeptide chain comprising an amino acid sequence at least 99% identical to SEQ ID NO: 176;
- (16) a first polypeptide chain comprising an amino acid sequence at least 99% identical to SEQ ID NO: 185 and a second polypeptide chain comprising an amino acid sequence at least 99% identical to SEQ ID NO: 186;
- (17) a first polypeptide chain comprising an amino acid sequence at least 99% identical to SEQ ID NO: 195 and a second polypeptide chain comprising an amino acid sequence at least 99% identical to SEQ ID NO: 196;
- (18) a first polypeptide chain comprising an amino acid sequence at least 99% identical to SEQ ID NO: 205 and a second polypeptide chain comprising an amino acid sequence at least 99% identical to SEQ ID NO: 206;
- (19) a first polypeptide chain comprising an amino acid sequence at least 99% identical to SEQ ID NO: 215 and a second polypeptide chain comprising an amino acid sequence at least 99% identical to SEQ ID NO: 216;
- (20) a first polypeptide chain comprising an amino acid sequence at least 99% identical to SEQ ID NO: 225 and a second polypeptide chain comprising an amino acid sequence at least 99% identical to SEQ ID NO: 226;
- (21) a first polypeptide chain comprising an amino acid sequence at least 99% identical to SEQ ID NO: 235 and a second polypeptide chain comprising an amino acid sequence at least 99% identical to SEQ ID NO: 236;
- (22) a first polypeptide chain comprising an amino acid sequence at least 99% identical to SEQ ID NO: 245 and a second polypeptide chain comprising an amino acid sequence at least 99% identical to SEQ ID NO: 246;
- (23) a first polypeptide chain comprising an amino acid sequence at least 99% identical to SEQ ID NO: 255 and a second polypeptide chain comprising an amino acid sequence at least 99% identical to SEQ ID NO: 256;
- (24) a first polypeptide chain comprising an amino acid sequence at least 99% identical to SEQ ID NO: 265 and a second polypeptide chain comprising an amino acid sequence at least 99% identical to SEQ ID NO: 266;
- (25) a first polypeptide chain comprising an amino acid sequence at least 99% identical to SEQ ID NO: 275 and a second polypeptide chain comprising an amino acid sequence at least 99% identical to SEQ ID NO: 276;
- (26) a first polypeptide chain comprising an amino acid sequence at least 99% identical to SEQ ID NO: 285 and a second polypeptide chain comprising an amino acid sequence at least 99% identical to SEQ ID NO: 286;
- (27) a first polypeptide chain comprising an amino acid sequence at least 99% identical to SEQ ID NO: 295 and a second polypeptide chain comprising an amino acid sequence at least 99% identical to SEQ ID NO: 296;
- (28) a first polypeptide chain comprising an amino acid sequence at least 99% identical to SEQ ID NO: 305 and a second polypeptide chain comprising an amino acid sequence at least 99% identical to SEQ ID NO: 306;
- (29) a first polypeptide chain comprising an amino acid sequence at least 99% identical to SEQ ID NO: 315 and a second polypeptide chain comprising an amino acid sequence at least 99% identical to SEQ ID NO: 316;
- (30) a first polypeptide chain comprising an amino acid sequence at least 99% identical to SEQ ID NO: 325 and a second polypeptide chain comprising an amino acid sequence at least 99% identical to SEQ ID NO: 326;
- (31) a first polypeptide chain comprising an amino acid sequence at least 99% identical to SEQ ID NO: 335 and a second polypeptide chain comprising an amino acid sequence at least 99% identical to SEQ ID NO: 336;
- (32) a first polypeptide chain comprising an amino acid sequence at least 99% identical to SEQ ID NO: 345 and a second polypeptide chain comprising an amino acid sequence at least 99% identical to SEQ ID NO: 346;
- (33) a first polypeptide chain comprising an amino acid sequence at least 99% identical to SEQ ID NO: 355 and a second polypeptide chain comprising an amino acid sequence at least 99% identical to SEQ ID NO: 356;

(34) a first polypeptide chain comprising an amino acid sequence at least 99% identical to SEQ ID NO: 365 and a second polypeptide chain comprising an amino acid sequence at least 99% identical to SEQ ID NO: 366;

(35) a first polypeptide chain comprising an amino acid sequence at least 99% identical to SEQ ID NO: 375 and a second polypeptide chain comprising an amino acid sequence at least 99% identical to SEQ ID NO: 376;

(36) a first polypeptide chain comprising an amino acid sequence at least 99% identical to SEQ ID NO: 385 and a second polypeptide chain comprising an amino acid sequence at least 99% identical to SEQ ID NO: 386;

(37) a first polypeptide chain comprising an amino acid sequence at least 99% identical to SEQ ID NO: 395 and a second polypeptide chain comprising an amino acid sequence at least 99% identical to SEQ ID NO: 396;

(38) a first polypeptide chain comprising an amino acid sequence at least 99% identical to SEQ ID NO: 405 and a second polypeptide chain comprising an amino acid sequence at least 99% identical to SEQ ID NO: 406;

(39) a first polypeptide chain comprising an amino acid sequence at least 99% identical to SEQ ID NO: 415 and a second polypeptide chain comprising an amino acid sequence at least 99% identical to SEQ ID NO: 416;

(40) a first polypeptide chain comprising an amino acid sequence at least 99% identical to SEQ ID NO: 425 and a second polypeptide chain comprising an amino acid sequence at least 99% identical to SEQ ID NO: 426;

(41) a first polypeptide chain comprising an amino acid sequence at least 99% identical to SEQ ID NO: 435 and a second polypeptide chain comprising an amino acid sequence at least 99% identical to SEQ ID NO: 436;

(42) a first polypeptide chain comprising an amino acid sequence at least 99% identical to SEQ ID NO: 445 and a second polypeptide chain comprising an amino acid sequence at least 99% identical to SEQ ID NO: 446;

(43) a first polypeptide chain comprising an amino acid sequence at least 99% identical to SEQ ID NO: 455 and a second polypeptide chain comprising an amino acid sequence at least 99% identical to SEQ ID NO: 456;

(44) a first polypeptide chain comprising an amino acid sequence at least 99% identical to SEQ ID NO: 465 and a second polypeptide chain comprising an amino acid sequence at least 99% identical to SEQ ID NO: 466;

(45) a first polypeptide chain comprising an amino acid sequence at least 99% identical to SEQ ID NO: 485 and a second polypeptide chain comprising an amino acid sequence at least 99% identical to SEQ ID NO: 486;

(46) a first polypeptide chain comprising an amino acid sequence at least 99% identical to SEQ ID NO: 495 and a second polypeptide chain comprising an amino acid sequence at least 99% identical to SEQ ID NO: 496;

(47) a first polypeptide chain comprising an amino acid sequence at least 99% identical to amino acids 21-267 of SEQ ID NO: 35 and a second polypeptide chain comprising an amino acid sequence at least 99% identical to amino acids 22-304 of SEQ ID NO: 36;

(48) a first polypeptide chain comprising an amino acid sequence at least 99% identical to amino acids 22-272 of SEQ ID NO: 45 and a second polypeptide chain comprising an amino acid sequence at least 99% identical to amino acids 20-305 of SEQ ID NO: 46;

(49) a first polypeptide chain comprising an amino acid sequence at least 99% identical to amino acids 19-264 of SEQ ID NO: 55 and a second polypeptide chain comprising an amino acid sequence at least 99% identical to amino acids 24-307 of SEQ ID NO: 56;

(50) a first polypeptide chain comprising an amino acid sequence at least 99% identical to amino acids 21-268 of SEQ ID NO: 65 and a second polypeptide chain comprising an amino acid sequence at least 99% identical to amino acids 22-305 of SEQ ID NO: 66;

(51) a first polypeptide chain comprising an amino acid sequence at least 99% identical to amino acids 21-268 of SEQ ID NO: 75 and a second polypeptide chain comprising an amino acid sequence at least 99% identical to amino acids 22-307 of SEQ ID NO: 76;

(52) a first polypeptide chain comprising an amino acid sequence at least 99% identical to amino acids 22-274 of SEQ ID NO: 85 and a second polypeptide chain comprising an amino acid sequence at least 99% identical to amino acids 22-306 of SEQ ID NO: 86;

(53) a first polypeptide chain comprising an amino acid sequence at least 99% identical to amino acids 22-268 of SEQ ID NO: 95 and a second polypeptide chain comprising an amino acid sequence at least 99% identical to amino acids 22-307 of SEQ ID NO: 96;

(54) a first polypeptide chain comprising an amino acid sequence at least 99% identical to amino acids 21-270 of SEQ ID NO: 105 and a second polypeptide chain comprising an amino acid sequence at least 99% identical to amino acids 22-302 of SEQ ID NO: 106;

(55) a first polypeptide chain comprising an amino acid sequence at least 99% identical to amino acids 19-263 of SEQ ID NO: 115 and a second polypeptide chain comprising an amino acid sequence at least 99% identical to amino acids 22-307 of SEQ ID NO: 116;

(56) a first polypeptide chain comprising an amino acid sequence at least 99% identical to amino acids 19-265 of SEQ ID NO: 125 and a second polypeptide chain comprising an amino acid sequence at least 99% identical to amino acids 22-307 of SEQ ID NO: 126;

(57) a first polypeptide chain comprising an amino acid sequence at least 99% identical to amino acids 19-265 of SEQ ID NO: 135 and a second polypeptide chain comprising an amino acid sequence at least 99% identical to amino acids 22-307 of SEQ ID NO: 136;

(58) a first polypeptide chain comprising an amino acid sequence at least 99% identical to amino acids 21-267 of SEQ ID NO: 145 and a second polypeptide chain comprising an amino acid sequence at least 99% identical to amino acids 22-304 of SEQ ID NO: 146;

(59) a first polypeptide chain comprising an amino acid sequence at least 99% identical to amino acids 20-265 of SEQ ID NO: 155 and a second polypeptide chain comprising an amino acid sequence at least 99% identical to amino acids 22-305 of SEQ ID NO: 156;

(60) a first polypeptide chain comprising an amino acid sequence at least 99% identical to amino acids 21-272 of SEQ ID NO: 165 and a second polypeptide chain comprising an amino acid sequence at least 99% identical to amino acids 22-305 of SEQ ID NO: 166;

(61) a first polypeptide chain comprising an amino acid sequence at least 99% identical to amino acids 21-270 of SEQ ID NO: 175 and a second polypeptide chain comprising an amino acid sequence at least 99% identical to amino acids 27-304 of SEQ ID NO: 176;

(62) a first polypeptide chain comprising an amino acid sequence at least 99% identical to amino acids 19-266 of SEQ ID NO: 185 and a second polypeptide chain comprising an amino acid sequence at least 99% identical to amino acids 27-305 of SEQ ID NO: 186;

(63) a first polypeptide chain comprising an amino acid sequence at least 99% identical to amino acids 22-271 of SEQ ID NO: 195 and a second polypeptide chain comprising an amino acid sequence at least 99% identical to amino acids 20-304 of SEQ ID NO: 196;
(64) a first polypeptide chain comprising an amino acid sequence at least 99% identical to amino acids 21-272 of SEQ ID NO: 205 and a second polypeptide chain comprising an amino acid sequence at least 99% identical to amino acids 22-307 of SEQ ID NO: 206;
(65) a first polypeptide chain comprising an amino acid sequence at least 99% identical to amino acids 22-273 of SEQ ID NO: 215 and a second polypeptide chain comprising an amino acid sequence at least 99% identical to amino acids 22-307 of SEQ ID NO: 216;
(66) a first polypeptide chain comprising an amino acid sequence at least 99% identical to amino acids 22-273 of SEQ ID NO: 225 and a second polypeptide chain comprising an amino acid sequence at least 99% identical to amino acids 22-307 of SEQ ID NO: 226;
(67) a first polypeptide chain comprising an amino acid sequence at least 99% identical to amino acids 22-271 of SEQ ID NO: 235 and a second polypeptide chain comprising an amino acid sequence at least 99% identical to amino acids 22-313 of SEQ ID NO: 236;
(68) a first polypeptide chain comprising an amino acid sequence at least 99% identical to amino acids 22-271 of SEQ ID NO: 245 and a second polypeptide chain comprising an amino acid sequence at least 99% identical to amino acids 17-303 of SEQ ID NO: 246;
(69) a first polypeptide chain comprising an amino acid sequence at least 99% identical to amino acids 20-262 of SEQ ID NO: 255 and a second polypeptide chain comprising an amino acid sequence at least 99% identical to amino acids 27-307 of SEQ ID NO: 256;
(70) a first polypeptide chain comprising an amino acid sequence at least 99% identical to amino acids 21-272 of SEQ ID NO: 265 and a second polypeptide chain comprising an amino acid sequence at least 99% identical to amino acids 22-311 of SEQ ID NO: 266;
(71) a first polypeptide chain comprising an amino acid sequence at least 99% identical to amino acids 22-311 of SEQ ID NO: 275 and a second polypeptide chain comprising an amino acid sequence at least 99% identical to amino acids 22-314 of SEQ ID NO: 276;
(72) a first polypeptide chain comprising an amino acid sequence at least 99% identical to amino acids 23-273 of SEQ ID NO: 285 and a second polypeptide chain comprising an amino acid sequence at least 99% identical to amino acids 17-304 of SEQ ID NO: 286;
(73) a first polypeptide chain comprising an amino acid sequence at least 99% identical to amino acids 22-272 of SEQ ID NO: 295 and a second polypeptide chain comprising an amino acid sequence at least 99% identical to amino acids 22-307 of SEQ ID NO: 296;
(74) a first polypeptide chain comprising an amino acid sequence at least 99% identical to amino acids 22-271 of SEQ ID NO: 305 and a second polypeptide chain comprising an amino acid sequence at least 99% identical to amino acids 22-306 of SEQ ID NO: 306;
(75) a first polypeptide chain comprising an amino acid sequence at least 99% identical to amino acids 23-271 of SEQ ID NO: 315 and a second polypeptide chain comprising an amino acid sequence at least 99% identical to amino acids 22-307 of SEQ ID NO: 316;
(76) a first polypeptide chain comprising an amino acid sequence at least 99% identical to amino acids 22-273 of SEQ ID NO: 325 and a second polypeptide chain comprising an amino acid sequence at least 99% identical to amino acids 22-308 of SEQ ID NO: 326;
(77) a first polypeptide chain comprising an amino acid sequence at least 99% identical to amino acids 19-262 of SEQ ID NO: 335 and a second polypeptide chain comprising an amino acid sequence at least 99% identical to amino acids 22-306 of SEQ ID NO: 336;
(78) a first polypeptide chain comprising an amino acid sequence at least 99% identical to amino acids 22-267 of SEQ ID NO: 345 and a second polypeptide chain comprising an amino acid sequence at least 99% identical to amino acids 22-305 of SEQ ID NO: 346;
(79) a first polypeptide chain comprising an amino acid sequence at least 99% identical to amino acids 22-267 of SEQ ID NO: 355 and a second polypeptide chain comprising an amino acid sequence at least 99% identical to amino acids 22-307 of SEQ ID NO: 356;
(80) a first polypeptide chain comprising an amino acid sequence at least 99% identical to amino acids 22-267 of SEQ ID NO: 365 and a second polypeptide chain comprising an amino acid sequence at least 99% identical to amino acids 22-307 of SEQ ID NO: 366;
(81) a first polypeptide chain comprising an amino acid sequence at least 99% identical to amino acids 21-270 of SEQ ID NO: 375 and a second polypeptide chain comprising an amino acid sequence at least 99% identical to amino acids 22-298 of SEQ ID NO: 376;
(82) a first polypeptide chain comprising an amino acid sequence at least 99% identical to amino acids 20-265 of SEQ ID NO: 385 and a second polypeptide chain comprising an amino acid sequence at least 99% identical to amino acids 25-305 of SEQ ID NO: 386;
(83) a first polypeptide chain comprising an amino acid sequence at least 99% identical to amino acids 22-268 of SEQ ID NO: 395 and a second polypeptide chain comprising an amino acid sequence at least 99% identical to amino acids 22-307 of SEQ ID NO: 396;
(84) a first polypeptide chain comprising an amino acid sequence at least 99% identical to amino acids 21-271 of SEQ ID NO: 405 and a second polypeptide chain comprising an amino acid sequence at least 99% identical to amino acids 22-307 of SEQ ID NO: 406;
(85) a first polypeptide chain comprising an amino acid sequence at least 99% identical to amino acids 21-271 of SEQ ID NO: 415 and a second polypeptide chain comprising an amino acid sequence at least 99% identical to amino acids 22-307 of SEQ ID NO: 416;
(86) a first polypeptide chain comprising an amino acid sequence at least 99% identical to amino acids 21-271 of SEQ ID NO: 425 and a second polypeptide chain comprising an amino acid sequence at least 99% identical to amino acids 22-307 of SEQ ID NO: 426;
(87) a first polypeptide chain comprising an amino acid sequence at least 99% identical to amino acids 21-271 of SEQ ID NO: 435 and a second polypeptide chain comprising an amino acid sequence at least 99% identical to amino acids 22-307 of SEQ ID NO: 436;
(88) a first polypeptide chain comprising an amino acid sequence at least 99% identical to amino acids 21-270 of SEQ ID NO: 445 and a second polypeptide chain comprising an amino acid sequence at least 99% identical to amino acids 22-303 of SEQ ID NO: 446;
(89) a first polypeptide chain comprising an amino acid sequence at least 99% identical to amino acids 21-270 of SEQ ID NO: 455 and a second polypeptide chain comprising an amino acid sequence at least 99% identical to amino acids 22-303 of SEQ ID NO: 456;
(90) a first polypeptide chain comprising an amino acid sequence at least 99% identical to amino acids 21-268 of SEQ ID NO: 465 and a second polypeptide chain comprising an amino acid sequence at least 99% identical to amino acids 22-313 of SEQ ID NO: 466;
(91) a first polypeptide chain comprising an amino acid sequence at least 99% identical to amino acids 21-270 of SEQ ID NO: 485 and a second polypeptide chain comprising an amino acid sequence at least 99% identical to amino acids 22-306 of SEQ ID NO: 486; or
(92) a first polypeptide chain comprising an amino acid sequence at least 99% identical to amino acids 23-271 of SEQ ID NO: 495 and a second polypeptide chain comprising an amino acid sequence at least 99% identical to amino acids 22-305 of SEQ ID NO: 496.

19. The protein of claim 15, wherein the protein comprises:
(1) a first polypeptide chain comprising the amino acid sequence of SEQ ID NO: 35 and a second polypeptide chain comprising the amino acid sequence of SEQ ID NO: 36;
(2) a first polypeptide chain comprising the amino acid sequence of SEQ ID NO: 45 and a second polypeptide chain comprising the amino acid sequence of SEQ ID NO: 46;
(3) a first polypeptide chain comprising the amino acid sequence of SEQ ID NO: 55 and a second polypeptide chain comprising the amino acid sequence of SEQ ID NO: 56;
(4) a first polypeptide chain comprising the amino acid sequence of SEQ ID NO: 65 and a second polypeptide chain comprising the amino acid sequence of SEQ ID NO: 66;
(5) a first polypeptide chain comprising the amino acid sequence of SEQ ID NO: 75 and a second polypeptide chain comprising the amino acid sequence of SEQ ID NO: 76;
(6) a first polypeptide chain comprising the amino acid sequence of SEQ ID NO: 85 and a second polypeptide chain comprising the amino acid sequence of SEQ ID NO: 86;
(7) a first polypeptide chain comprising the amino acid sequence of SEQ ID NO: 95 and a second polypeptide chain comprising the amino acid sequence of SEQ ID NO: 96;
(8) a first polypeptide chain comprising the amino acid sequence of SEQ ID NO: 105 and a second polypeptide chain comprising the amino acid sequence of SEQ ID NO: 106;
(9) a first polypeptide chain comprising the amino acid sequence of SEQ ID NO: 115 and a second polypeptide chain comprising the amino acid sequence of SEQ ID NO: 116;
(10) a first polypeptide chain comprising the amino acid sequence of SEQ ID NO: 125 and a second polypeptide chain comprising the amino acid sequence of SEQ ID NO: 126;
(11) a first polypeptide chain comprising the amino acid sequence of SEQ ID NO: 135 and a second polypeptide chain comprising the amino acid sequence of SEQ ID NO: 136;
(12) a first polypeptide chain comprising the amino acid sequence of SEQ ID NO: 145 and a second polypeptide chain comprising the amino acid sequence of SEQ ID NO: 146;
(13) a first polypeptide chain comprising the amino acid sequence of SEQ ID NO: 155 and a second polypeptide chain comprising the amino acid sequence of SEQ ID NO: 156;
(14) a first polypeptide chain comprising the amino acid sequence of SEQ ID NO: 165 and a second polypeptide chain comprising the amino acid sequence of SEQ ID NO: 166;
(15) a first polypeptide chain comprising the amino acid sequence of SEQ ID NO: 175 and a second polypeptide chain comprising the amino acid sequence of SEQ ID NO: 176;
(16) a first polypeptide chain comprising the amino acid sequence of SEQ ID NO: 185 and a second polypeptide chain comprising the amino acid sequence of SEQ ID NO: 186;
(17) a first polypeptide chain comprising the amino acid sequence of SEQ ID NO: 195 and a second polypeptide chain comprising the amino acid sequence of SEQ ID NO: 196;
(18) a first polypeptide chain comprising the amino acid sequence of SEQ ID NO: 205 and a second polypeptide chain comprising the amino acid sequence of SEQ ID NO: 206;
(19) a first polypeptide chain comprising the amino acid sequence of SEQ ID NO: 215 and a second polypeptide chain comprising the amino acid sequence of SEQ ID NO: 216;
(20) a first polypeptide chain comprising the amino acid sequence of SEQ ID NO: 225 and a second polypeptide chain comprising the amino acid sequence of SEQ ID NO: 226;
(21) a first polypeptide chain comprising the amino acid sequence of SEQ ID NO: 235 and a second polypeptide chain comprising the amino acid sequence of SEQ ID NO: 236;
(22) a first polypeptide chain comprising the amino acid sequence of SEQ ID NO: 245 and a second polypeptide chain comprising the amino acid sequence of SEQ ID NO: 246;
(23) a first polypeptide chain comprising the amino acid sequence of SEQ ID NO: 255 and a second polypeptide chain comprising the amino acid sequence of SEQ ID NO: 256;
(24) a first polypeptide chain comprising the amino acid sequence of SEQ ID NO: 265 and a second polypeptide chain comprising the amino acid sequence of SEQ ID NO: 266;
(25) a first polypeptide chain comprising the amino acid sequence of SEQ ID NO: 275 and a second polypeptide chain comprising the amino acid sequence of SEQ ID NO: 276;
(26) a first polypeptide chain comprising the amino acid sequence of SEQ ID NO: 285 and a second polypeptide chain comprising the amino acid sequence of SEQ ID NO: 286;
(27) a first polypeptide chain comprising the amino acid sequence of SEQ ID NO: 295 and a second polypeptide chain comprising the amino acid sequence of SEQ ID NO: 296;
(28) a first polypeptide chain comprising the amino acid sequence of SEQ ID NO: 305 and a second polypeptide chain comprising the amino acid sequence of SEQ ID NO: 306;

(29) a first polypeptide chain comprising the amino acid sequence of SEQ ID NO: 315 and a second polypeptide chain comprising the amino acid sequence of SEQ ID NO: 316;
(30) a first polypeptide chain comprising the amino acid sequence of SEQ ID NO: 325 and a second polypeptide chain comprising the amino acid sequence of SEQ ID NO: 326;
(31) a first polypeptide chain comprising the amino acid sequence of SEQ ID NO: 335 and a second polypeptide chain comprising the amino acid sequence of SEQ ID NO: 336;
(32) a first polypeptide chain comprising the amino acid sequence of SEQ ID NO: 345 and a second polypeptide chain comprising the amino acid sequence of SEQ ID NO: 346;
(33) a first polypeptide chain comprising the amino acid sequence of SEQ ID NO: 355 and a second polypeptide chain comprising the amino acid sequence of SEQ ID NO: 356;
(34) a first polypeptide chain comprising the amino acid sequence of SEQ ID NO: 365 and a second polypeptide chain comprising the amino acid sequence of SEQ ID NO: 366;
(35) a first polypeptide chain comprising the amino acid sequence of SEQ ID NO: 375 and a second polypeptide chain comprising the amino acid sequence of SEQ ID NO: 376;
(36) a first polypeptide chain comprising the amino acid sequence of SEQ ID NO: 385 and a second polypeptide chain comprising the amino acid sequence of SEQ ID NO: 386;
(37) a first polypeptide chain comprising the amino acid sequence of SEQ ID NO: 395 and a second polypeptide chain comprising the amino acid sequence of SEQ ID NO: 396;
(38) a first polypeptide chain comprising the amino acid sequence of SEQ ID NO: 405 and a second polypeptide chain comprising the amino acid sequence of SEQ ID NO: 406;
(39) a first polypeptide chain comprising the amino acid sequence of SEQ ID NO: 415 and a second polypeptide chain comprising the amino acid sequence of SEQ ID NO: 416;
(40) a first polypeptide chain comprising the amino acid sequence of SEQ ID NO: 425 and a second polypeptide chain comprising the amino acid sequence of SEQ ID NO: 426;
(41) a first polypeptide chain comprising the amino acid sequence of SEQ ID NO: 435 and a second polypeptide chain comprising the amino acid sequence of SEQ ID NO: 436;
(42) a first polypeptide chain comprising the amino acid sequence of SEQ ID NO: 445 and a second polypeptide chain comprising the amino acid sequence of SEQ ID NO: 446;
(43) a first polypeptide chain comprising the amino acid sequence of SEQ ID NO: 455 and a second polypeptide chain comprising the amino acid sequence of SEQ ID NO: 456;
(44) a first polypeptide chain comprising the amino acid sequence of SEQ ID NO: 465 and a second polypeptide chain comprising the amino acid sequence of SEQ ID NO: 466;
(45) a first polypeptide chain comprising the amino acid sequence of SEQ ID NO: 485 and a second polypeptide chain comprising the amino acid sequence of SEQ ID NO: 486;
(46) a first polypeptide chain comprising the amino acid sequence of SEQ ID NO: 495 and a second polypeptide chain comprising the amino acid sequence of SEQ ID NO: 496;
(47) a first polypeptide chain comprising amino acids 21-267 of SEQ ID NO: 35 and a second polypeptide chain comprising amino acids 22-304 of SEQ ID NO: 36;
(48) a first polypeptide chain comprising amino acids 22-272 of SEQ ID NO: 45 and a second polypeptide chain comprising amino acids 20-305 of SEQ ID NO: 46;
(49) a first polypeptide chain comprising amino acids 19-264 of SEQ ID NO: 55 and a second polypeptide chain comprising amino acids 24-307 of SEQ ID NO: 56;
(50) a first polypeptide chain comprising amino acids 21-268 of SEQ ID NO: 65 and a second polypeptide chain comprising amino acids 22-305 of SEQ ID NO: 66;
(51) a first polypeptide chain comprising amino acids 21-268 of SEQ ID NO: 75 and a second polypeptide chain comprising amino acids 22-307 of SEQ ID NO: 76;
(52) a first polypeptide chain comprising amino acids 22-274 of SEQ ID NO: 85 and a second polypeptide chain comprising amino acids 22-306 of SEQ ID NO: 86;
(53) a first polypeptide chain comprising amino acids 22-268 of SEQ ID NO: 95 and a second polypeptide chain comprising amino acids 22-307 of SEQ ID NO: 96;
(54) a first polypeptide chain comprising amino acids 21-270 of SEQ ID NO: 105 and a second polypeptide chain comprising amino acids 22-302 of SEQ ID NO: 106;
(55) a first polypeptide chain comprising amino acids 19-263 of SEQ ID NO: 115 and a second polypeptide chain comprising amino acids 22-307 of SEQ ID NO: 116;
(56) a first polypeptide chain comprising amino acids 19-265 of SEQ ID NO: 125 and a second polypeptide chain comprising amino acids 22-307 of SEQ ID NO: 126;
(57) a first polypeptide chain comprising amino acids 19-265 of SEQ ID NO: 135 and a second polypeptide chain comprising amino acids 22-307 of SEQ ID NO: 136;
(58) a first polypeptide chain comprising amino acids 21-267 of SEQ ID NO: 145 and a second polypeptide chain comprising amino acids 22-304 of SEQ ID NO: 146;
(59) a first polypeptide chain comprising amino acids 20-265 of SEQ ID NO: 155 and a second polypeptide chain comprising amino acids 22-305 of SEQ ID NO: 156;
(60) a first polypeptide chain comprising amino acids 21-272 of SEQ ID NO: 165 and a second polypeptide chain comprising amino acids 22-305 of SEQ ID NO: 166;

(61) a first polypeptide chain comprising amino acids 21-270 of SEQ ID NO: 175 and a second polypeptide chain comprising amino acids 27-304 of SEQ ID NO: 176;
(62) a first polypeptide chain comprising amino acids 19-266 of SEQ ID NO: 185 and a second polypeptide chain comprising amino acids 27-305 of SEQ ID NO: 186;
(63) a first polypeptide chain comprising amino acids 22-271 of SEQ ID NO: 195 and a second polypeptide chain comprising amino acids 20-304 of SEQ ID NO: 196;
(64) a first polypeptide chain comprising amino acids 21-272 of SEQ ID NO: 205 and a second polypeptide chain comprising amino acids 22-307 of SEQ ID NO: 206;
(65) a first polypeptide chain comprising amino acids 22-273 of SEQ ID NO: 215 and a second polypeptide chain comprising amino acids 22-307 of SEQ ID NO: 216;
(66) a first polypeptide chain comprising amino acids 22-273 of SEQ ID NO: 225 and a second polypeptide chain comprising amino acids 22-307 of SEQ ID NO: 226;
(67) a first polypeptide chain comprising amino acids 22-271 of SEQ ID NO: 235 and a second polypeptide chain comprising amino acids 22-313 of SEQ ID NO: 236;
(68) a first polypeptide chain comprising amino acids 22-271 of SEQ ID NO: 245 and a second polypeptide chain comprising amino acids 17-303 of SEQ ID NO: 246;
(69) a first polypeptide chain comprising amino acids 20-262 of SEQ ID NO: 255 and a second polypeptide chain comprising amino acids 27-307 of SEQ ID NO: 256;
(70) a first polypeptide chain comprising amino acids 21-272 of SEQ ID NO: 265 and a second polypeptide chain comprising amino acids 22-311 of SEQ ID NO: 266;
(71) a first polypeptide chain comprising amino acids 23-273 of SEQ ID NO: 275 and a second polypeptide chain comprising amino acids 22-314 of SEQ ID NO: 276;
(72) a first polypeptide chain comprising amino acids 23-273 of SEQ ID NO: 285 and a second polypeptide chain comprising amino acids 17-304 of SEQ ID NO: 286;
(73) a first polypeptide chain comprising amino acids 22-272 of SEQ ID NO: 295 and a second polypeptide chain comprising amino acids 22-307 of SEQ ID NO: 296;
(74) a first polypeptide chain comprising amino acids 22-271 of SEQ ID NO: 305 and a second polypeptide chain comprising amino acids 22-306 of SEQ ID NO: 306;
(75) a first polypeptide chain comprising amino acids 23-271 of SEQ ID NO: 315 and a second polypeptide chain comprising amino acids 22-307 of SEQ ID NO: 316;
(76) a first polypeptide chain comprising amino acids 22-273 of SEQ ID NO: 325 and a second polypeptide chain comprising amino acids 22-308 of SEQ ID NO: 326;
(77) a first polypeptide chain comprising amino acids 19-262 of SEQ ID NO: 335 and a second polypeptide chain comprising amino acids 22-306 of SEQ ID NO: 336;
(78) a first polypeptide chain comprising amino acids 22-267 of SEQ ID NO: 345 and a second polypeptide chain comprising amino acids 22-305 of SEQ ID NO: 346;
(79) a first polypeptide chain comprising amino acids 22-267 of SEQ ID NO: 355 and a second polypeptide chain comprising amino acids 22-307 of SEQ ID NO: 356;
(80) a first polypeptide chain comprising amino acids 22-267 of SEQ ID NO: 365 and a second polypeptide chain comprising amino acids 22-307 of SEQ ID NO: 366;
(81) a first polypeptide chain comprising amino acids 21-270 of SEQ ID NO: 375 and a second polypeptide chain comprising amino acids 22-298 of SEQ ID NO: 376;
(82) a first polypeptide chain comprising amino acids 20-265 of SEQ ID NO: 385 and a second polypeptide chain comprising amino acids 25-305 of SEQ ID NO: 386;
(83) a first polypeptide chain comprising amino acids 22-268 of SEQ ID NO: 395 and a second polypeptide chain comprising amino acids 22-307 of SEQ ID NO: 396;
(84) a first polypeptide chain comprising amino acids 21-271 of SEQ ID NO: 405 and a second polypeptide chain comprising amino acids 22-307 of SEQ ID NO: 406;
(85) a first polypeptide chain comprising amino acids 21-271 of SEQ ID NO: 415 and a second polypeptide chain comprising amino acids 22-307 of SEQ ID NO: 416;
(86) a first polypeptide chain comprising amino acids 21-271 of SEQ ID NO: 425 and a second polypeptide chain comprising amino acids 22-307 of SEQ ID NO: 426;
(87) a first polypeptide chain comprising amino acids 21-271 of SEQ ID NO: 435 and a second polypeptide chain comprising amino acids 22-307 of SEQ ID NO: 436;
(88) a first polypeptide chain comprising amino acids 21-270 of SEQ ID NO: 445 and a second polypeptide chain comprising amino acids 22-303 of SEQ ID NO: 446;
(89) a first polypeptide chain comprising amino acids 21-270 of SEQ ID NO: 455 and a second polypeptide chain comprising amino acids 22-303 of SEQ ID NO: 456;
(90) a first polypeptide chain comprising amino acids 21-268 of SEQ ID NO: 465 and a second polypeptide chain comprising amino acids 22-313 of SEQ ID NO: 466;
(91) a first polypeptide chain comprising amino acids 21-270 of SEQ ID NO: 485 and a second polypeptide chain comprising amino acids 22-306 of SEQ ID NO: 486; or
(92) a first polypeptide chain comprising amino acids 23-271 of SEQ ID NO: 495 and a second polypeptide chain comprising amino acids 22-305 of SEQ ID NO: 496.

\* \* \* \* \*

UNITED STATES PATENT AND TRADEMARK OFFICE
CERTIFICATE OF CORRECTION

| | | |
|---|---|---|
| PATENT NO. | : 11,939,365 B2 | Page 1 of 1 |
| APPLICATION NO. | : 16/651242 | |
| DATED | : March 26, 2024 | |
| INVENTOR(S) | : Deniger et al. | |

It is certified that error appears in the above-identified patent and that said Letters Patent is hereby corrected as shown below:

On the Title Page:

The first or sole Notice should read --

Subject to any disclaimer, the term of this patent is extended or adjusted under 35 U.S.C. 154(b) by 688 days.

Signed and Sealed this
Twenty-sixth Day of August, 2025

Coke Morgan Stewart
*Acting Director of the United States Patent and Trademark Office*